(12) United States Patent
Georges et al.

(10) Patent No.: US 11,608,376 B2
(45) Date of Patent: *Mar. 21, 2023

(54) TUMOR-TARGETED AGONISTIC CD28 ANTIGEN BINDING MOLECULES

(71) Applicant: Hoffmann-La Roche Inc., Little Falls, NJ (US)

(72) Inventors: Guy Georges, Penzberg (DE); Thomas Hofer, Schlieren (CH); Ralf Hosse, Schlieren (CH); Christian Klein, Schlieren (CH); Ekkehard Moessner, Schlieren (CH); Johannes Sam, Schlieren (CH); Pablo Umaña, Schlieren (CH); Jenny Thom, Schlieren (CH); Stephan Gasser, Schlieren (CH); Jean-Baptiste Vallier, Schlieren (CH); Tanja Fauti, Schlieren (CH)

(73) Assignee: Hoffmann-La Roche Inc., Little Falls, NJ (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/721,272

(22) Filed: Dec. 19, 2019

(65) Prior Publication Data

US 2020/0199234 A1  Jun. 25, 2020

(30) Foreign Application Priority Data

Dec. 21, 2018 (EP) .................................. 18215121
Jul. 23, 2019 (EP) .................................. 19187709
Sep. 6, 2019 (EP) .................................. 19196006

(51) Int. Cl.
| | |
|---|---|
| C07K 16/28 | (2006.01) |
| C07K 16/30 | (2006.01) |
| C07K 16/32 | (2006.01) |
| C07K 16/40 | (2006.01) |
| A61P 35/00 | (2006.01) |
| A61K 39/00 | (2006.01) |

(52) U.S. Cl.
CPC .......... *C07K 16/2818* (2013.01); *A61P 35/00* (2018.01); *C07K 16/2803* (2013.01); *C07K 16/286* (2013.01); *C07K 16/2878* (2013.01); *C07K 16/2896* (2013.01); *C07K 16/30* (2013.01); *C07K 16/3007* (2013.01); *C07K 16/32* (2013.01); *C07K 16/40* (2013.01); *A61K 2039/505* (2013.01); *C07K 2317/31* (2013.01); *C07K 2317/35* (2013.01); *C07K 2317/52* (2013.01); *C07K 2317/55* (2013.01); *C07K 2317/565* (2013.01); *C07K 2317/75* (2013.01); *C07K 2317/92* (2013.01)

(58) Field of Classification Search
CPC ............ C07K 16/2818; C07K 2317/31; C07K 2317/55; C07K 16/286; C07K 16/2878; C07K 16/30; C07K 16/3007; C07K 16/32; C07K 16/40; C07K 2317/52; C07K 2317/565

See application file for complete search history.

(56) References Cited

U.S. PATENT DOCUMENTS

| | | | |
|---|---|---|---|
| 7,632,925 B2 | 12/2009 | Kufer et al. |
| 7,829,673 B2 | 9/2010 | De Weers et al. |
| 8,263,083 B2 | 11/2012 | Oflazoglu et al. |
| 9,011,847 B2 | 4/2015 | Bacac et al. |
| 9,266,938 B2 | 2/2016 | Ast et al. |
| 9,447,159 B2 | 9/2016 | Ast et al. |
| 9,526,797 B2 | 12/2016 | Gerdes et al. |
| 9,926,379 B2 | 3/2018 | Bruenker et al. |
| 9,969,809 B2 | 5/2018 | Kuo et al. |
| 10,184,009 B2 | 1/2019 | Ast et al. |
| 10,464,981 B2 | 5/2019 | Amann et al. |
| 10,323,098 B2 | 6/2019 | Ast et al. |
| 10,392,445 B2 | 8/2019 | Amann et al. |
| 10,253,110 B2 | 9/2019 | Bacac et al. |
| 10,316,104 B2 | 11/2019 | Ast et al. |
| 10,202,464 B2 | 12/2019 | Ast et al. |
| 10,577,429 B2 | 3/2020 | Bacac et al. |
| 10,603,360 B2 | 3/2020 | Gerdes et al. |
| 10,526,413 B2 | 7/2020 | Amann et al. |
| 10,781,262 B2 | 9/2020 | Klien et al. |
| 11,111,312 B2 | 7/2021 | Ast et al. |
| 11,130,822 B2 | 9/2021 | Ast et al. |
| 11,149,083 B2 | 10/2021 | Amann et al. |
| 11,285,207 B2 | 3/2022 | Codarri-Deak et al. |
| 11,286,300 B2 | 3/2022 | Ferrara Koller et al. |
| 11,214,622 B2 | 4/2022 | Bruenker et al. |
| 11,306,154 B2 | 4/2022 | Amann et al. |
| 11,332,545 B2 | 5/2022 | Bacac et al. |

(Continued)

FOREIGN PATENT DOCUMENTS

| | | |
|---|---|---|
| JP | 2010-512421 A | 4/2010 |
| JP | 2011-500582 A | 1/2011 |

(Continued)

OTHER PUBLICATIONS

Bohlen et al., Cancer Research, 1993, 53:4310-4314.*

(Continued)

*Primary Examiner* — Hong Sang
(74) *Attorney, Agent, or Firm* — Yan Qi

(57) ABSTRACT

The present invention relates to tumor targeted bispecific agonistic antigen binding molecules characterized by monovalent binding to CD28, methods for their production, pharmaceutical compositions containing these antibodies, and methods of using the same.

49 Claims, 68 Drawing Sheets
Specification includes a Sequence Listing.

(56) References Cited

U.S. PATENT DOCUMENTS

| | | | |
|---|---|---|---|
| 11,242,396 B2 | 8/2022 | Bruenker et al. | |
| 11,267,903 B2 | 8/2022 | Amann et al. | |
| 2011/0189735 A1 | 4/2011 | Hanke et al. | |
| 2014/0030280 A1 | 1/2014 | Polakis et al. | |
| 2014/0242080 A1* | 8/2014 | Jaeger | C07K 16/2809 |
| | | | 435/254.2 |
| 2014/0370019 A1* | 12/2014 | Bruenker | A61K 39/39558 |
| | | | 435/69.6 |
| 2015/0119555 A1* | 4/2015 | Jung | A61P 35/00 |
| | | | 530/387.3 |
| 2017/0174786 A1* | 6/2017 | Bacac | C07K 16/2863 |
| 2017/0247467 A1 | 8/2017 | Amann et al. | |
| 2018/0230215 A1 | 8/2018 | Hofer et al. | |
| 2018/0340030 A1 | 11/2018 | Bruenker et al. | |
| 2019/0016771 A1 | 1/2019 | Amann et al. | |
| 2019/0153115 A1 | 5/2019 | Schellenberger et al. | |
| 2019/0185566 A1 | 6/2019 | Koller et al. | |
| 2019/0194291 A1 | 6/2019 | Bruenker et al. | |
| 2019/0233534 A1* | 8/2019 | Mehlin | C07K 16/2827 |
| 2019/0322763 A1 | 10/2019 | Ast et al. | |
| 2019/0322765 A1 | 10/2019 | Ast et al. | |
| 2019/0211113 A1 | 11/2019 | Amann et al. | |
| 2020/0093860 A1 | 3/2020 | Stubenrauch et al. | |
| 2020/0093861 A1 | 3/2020 | Klein et al. | |
| 2020/0277392 A1 | 3/2020 | Amann et al. | |
| 2020/0071411 A1 | 5/2020 | Amann et al. | |
| 2020/0347115 A1 | 5/2020 | Duerr et al. | |
| 2020/0188526 A1 | 6/2020 | Klein et al. | |
| 2020/0190206 A1 | 6/2020 | Koller et al. | |
| 2020/0197492 A1 | 6/2020 | Gerdes et al. | |
| 2020/0223925 A1 | 7/2020 | Gasser et al. | |
| 2020/0231691 A1 | 7/2020 | Grau-Richards et al. | |
| 2020/0270321 A1 | 8/2020 | Amann et al. | |
| 2020/0317774 A1 | 8/2020 | Hofer et al. | |
| 2020/0325225 A1 | 10/2020 | Bacac et al. | |
| 2020/0325238 A1 | 10/2020 | Bacac et al. | |
| 2020/0392237 A1 | 12/2020 | Bacac et al. | |
| 2021/0009656 A1 | 1/2021 | Bruenker et al. | |
| 2021/0024610 A1 | 1/2021 | Koller et al. | |
| 2021/0095002 A1 | 1/2021 | Claus et al. | |
| 2021/0054021 A1 | 2/2021 | Deak Codarri et al. | |
| 2021/0163617 A1 | 3/2021 | Ferrara et al. | |
| 2021/0137977 A1* | 5/2021 | Chaudhary | A61K 35/17 |
| 2021/0188992 A1 | 6/2021 | Bruenker et al. | |
| 2021/0253724 A1 | 8/2021 | Claus et al. | |
| 2021/0292426 A1 | 9/2021 | Duerr et al. | |
| 2021/0324108 A1 | 10/2021 | Amann et al. | |
| 2021/0070882 A1 | 11/2021 | Bacac et al. | |
| 2022/0017637 A1 | 1/2022 | Gasser et al. | |
| 2022/0025046 A1 | 1/2022 | Amann et al. | |
| 2022/0025069 A1 | 1/2022 | Claus et al. | |
| 2022/0227878 A1 | 7/2022 | Bruenker et al. | |
| 2022/0073646 A1 | 10/2022 | Amann et al. | |

FOREIGN PATENT DOCUMENTS

| | | |
|---|---|---|
| JP | 2012-522524 A | 9/2012 |
| JP | 2015502373 | 1/2015 |
| JP | 2015-523380 A | 8/2015 |
| JP | 2018-516068 A | 6/2018 |
| JP | 2018-533929 A | 11/2018 |
| JP | 2018-553909 A | 11/2018 |
| WO | 2006/050949 A2 | 5/2006 |
| WO | 2006/050949 A3 | 5/2006 |
| WO | 2007/071422 A2 | 6/2007 |
| WO | 2009/012268 A1 | 1/2009 |
| WO | 2010/115552 A1 | 10/2010 |
| WO | 2010/115552 A8 | 10/2010 |
| WO | 2011/076683 A1 | 6/2011 |
| WO | 2012/020006 A2 | 2/2012 |
| WO | 2012/130831 A1 | 10/2012 |
| WO | 2013/092001 A1 | 6/2013 |
| WO | 2014/131712 A1 | 9/2014 |
| WO | 2015/150447 A1 | 10/2015 |
| WO | 2016/075278 A1 | 5/2016 |
| WO | 2016/166629 A1 | 10/2016 |
| WO | 2017/055328 A1 | 4/2017 |
| WO | 2017/055541 A1 | 4/2017 |
| WO | 2017/072207 A1 | 5/2017 |
| WO | 2017/162890 A1 | 9/2017 |
| WO | 2018/014001 A1 | 1/2018 |
| WO | 2018/017786 A2 | 1/2018 |
| WO | 2018/114748 A1 | 6/2018 |
| WO | 2018/114754 A1 | 6/2018 |
| WO | 2018/127473 A1 | 7/2018 |
| WO | 2018/177966 A1 | 10/2018 |
| WO | 2018/177967 A1 | 10/2018 |
| WO | 2019/154890 A1 | 8/2019 |
| WO | 2020/260329 A1 | 12/2020 |
| WO | 2021/140130 A1 | 7/2021 |
| WO | 2021/198335 A1 | 10/2021 |
| WO | 2021/260064 A1 | 12/2021 |

OTHER PUBLICATIONS

Paul, Fundamental Immunology, 3rd Edition, 1993, pp. 292-295.*
Rudikoff et al., Proc. Natl. Acad. Sci. USA, 1982, 79(6):1979-1983.*
Colman, Research in Immunology, 1994, 145:33-36.*
Bendig, Methods: A Companion to Methods in Enzymology, 1995; 8:83-93.*
Khantasup et al., Monoclonal Antibodies in Immunodiagnosis and Immunotherapy, 2015, 34(6): 404-417.*
Murphy et al. (Journal of Immunological Methods, vol. 463, p. 127-133, 2018.*
International Search Report and Written Opinion for PCT/EP2019/086143 dated Mar. 10, 2020.
Acuto et al., "CD28-mediated co-stimulation: a quantitative support for TCR signalling." Nat. Rev. Immunol. 3:939-951 ( 2003).
Atamaniuk, J., et al., "Overexpression of G protein-coupled receptor 5D in the bone marrow is associated with poor prognosis in patients with multiple myeloma" Eur J Clin Invest 42(9):953-960 (Sep. 1, 2012).
Bahlis et al., "CD28-mediated regulation of multiple myeloma cell proliferation and survival" Blood 109(11):5002-5010 ( 2007).
Banfield, M.J., et al., "VL:VH domain rotations in engineered antibodies: crystal structures of the Fab fragments from two murine antitumor antibodies and their engineered human contructs" Proteins 29(2):161-171 (Oct. 1, 1997).
Beyersdorf et al., "Superagonistic anti-CD28 antibodies: potent activators of regulatory T cells for the therapy of autoimmune diseases" Ann Rheum Dis 64:91-95 ( 2005).
Boomer and Green et al., "An Enigmatic Tail of CD28 Signaling" Herb Perspect Biol. 2(a002436):1-20 ( 2010).
Brauner-Osborne, H., et al., "Cloning and characterization of a human orphan family C G-protein coupled receptor GPRC5D" Biochim Biophys ACTA 1518(3):237-248 (Apr. 16, 2001).
Carreno and Collins et al., "The B7 Family of Ligands and Its Receptors: New Pathways for Costimulation and Inhibition of Immune Responses" Annu Rev Immunol(20):29-53 (2002).
Chen et al., "Molecular mechanisms of T cell co-stimulation and co-inhibition" Nat. Rev. Immunol. 13:227-242 ( 2013).
Cho et al., "Targeting B Cell Maturation Antigen (BCMA) in Multiple Myeloma: Potential Uses of BCMA-Based Immunotherapy" Front Immunol 9:1-15 ( 2018).
Cohen et al., "GPRC5D is a promising marker for monitoring the tumor load and to target multiple myeloma cells. Hematology" Hematology 18(6):348-51 ( 2013).
Engelhardt et al., "CTLA-4 Overexpression Inhibits T Cell Responses through a CD28-B7-Dependent Mechanism" J. Immunol. 177:1052-1061 ( 2003).
Esensten et al., "CD28 costimulation: from mechanism to therapy" Immunity 44(5):973-988 ( 2016).
Fraser et al., "Regulation of interleukin-2 gene enhancer activity by the T cell accessory molecule CD28" Science 251:313-316 ( 1991).
Gao, Y., et al., "Comparative Transcriptome Analysis of Fetal Skin Reveals Key Genes. Related to Hair Follicle Morphogenesis in Cashmere Goats" PLOS ONE 11(3 Suppl e0151118):1-20 (Mar. 9, 2016).

(56) References Cited

OTHER PUBLICATIONS

Hui et al., "T cell costimulatory receptor CD28 is a primary target for PD-1—mediated inhibition" Science 355:1428-1433 ( 2017).
Hunig et al., "The storm has cleared: lessons from the CD28 superagonist TGN1412 trial" Nat. Rev. Immunol. 12:317-318 ( 2012).
Inoue, S., et al., "The RAIG family member, GPRC5D, is associated with hard-keratinized structures" J Invest Dematol 122(3):565-573 (Mar. 1, 2004).
June et al., "T-Cell Proliferation Involving the CD28 Pathway is Associated with Cyclosporine-Resistant Interleukin 2 Gene Expression" Mol. Cell .Biol. 7(12):4472-4481 (1987).
Kamphorst et al., "Rescue of exhausted CD8 T cells by PD-1—targeted therapies is CD28-dependent" Science 355:1423-1427 ( 2017).
Lavin et al., "Innate Immune Landscape in Early Lung Adenocarcinoma by Paired Single-Cell Analyses" Cell 169:750-765 ( 2017).
Linsley et al., "T-cell antigen CD28 mediates adhesion with B cells by interacting with activation antigen B7/BB-1" Proc. Natl. Acad. Sci. USA 87:5031-5035 ( 1990).
Moreau, P., et al., "Multiple myeloma—translation of trial results into reality" Lancet 388(10040):111-113 (Jul. 9, 2016).
Murray et al., "CD28-medicated pro-survival signaling induces chemotherapeutic resistance in multiple myeloma" Blood 123(24):3770-3779, 2014.
Otz, T., et al., "A bispecific single-chain antibody that mediates target cell-restricted, supra-agonistic CD28 stimulation and killing of lymphona cells" Leukemia 23(1):71-77 (Oct. 2, 2008).
Romer et al., "Preculture of PBMCs at high cell density increases sensitivity of T-cell responses, revealing cytokine release by CD28 superagonist TGN1412" Blood 118(26):6772-6782 ( 2011).
Silacci, M., et al., "Design, construction, and characterization of a large synthetic human antibody phage display library" Proteomics 5(9):2340-2350 (Jun. 1, 2005).
Tai et al., "Induction of autoimmune disease in CTLA-4-/- mice depends on a specific CD28 motif that is required for in vivo costimulation"Proc. Natl. Sci. USA 104:13756-13761 ( 2007).
Tan, et al., "Superhumanized Antibodies: Reduction of Immunogenic Potential by Complementarity-Determining Region Grafting with Human Germline Sequences: Application to an Anti-CD28" Journal of Immunology 169:1119-1125 (2002).
Thompson et al., "CD28 activation pathway regulates the production of multiple T-cell-derived lymphokines/cytokines" Proc Natl Acad Sci U S A 86:1333-1337 ( 1989).
Tirosh et al., "Dissecting the multicellular ecosystem of metastatic melanoma by single-cell RNA-seq" Science 352:189-196 ( 2016).
Zheng et al., "Landscape of Infiltrating T Cells in Liver Cancer Revealed by Single-Cell Sequencing" Cell 169:1342-1356 ( 2017).
Bohlen et al., "Cytolysis of Leukemic B-Cells by T-Cells Activated via Two Bispecific Antibodies" Cancer RES 53:4310-4314 ( 1993).
Reihchert et al., "Foundation Review: The Future of Antibodies as Cancer Drugs" Drug Discov Today 17(17):954-963 ( 2012).
Arilin et al., "Fundamentals of Immunology" Medicina:1-3 ( 1999).
Filippovic et al., "Biochemical Basis of Human Life" University Textboo: Vlados:49-50 ( 2005).
Brandl, M., et al., "Bispecific antibody fragments with CD20 x CD28 specificity allow effective atuologous and allogeneic T-cell activation against malignant cells in peripheral blood and bone marrow cultures from patients with B-cell lineage leukemia and lymphoa" Exp Hematol 27(8):1264-1270 (Aug. 1, 1999).

* cited by examiner

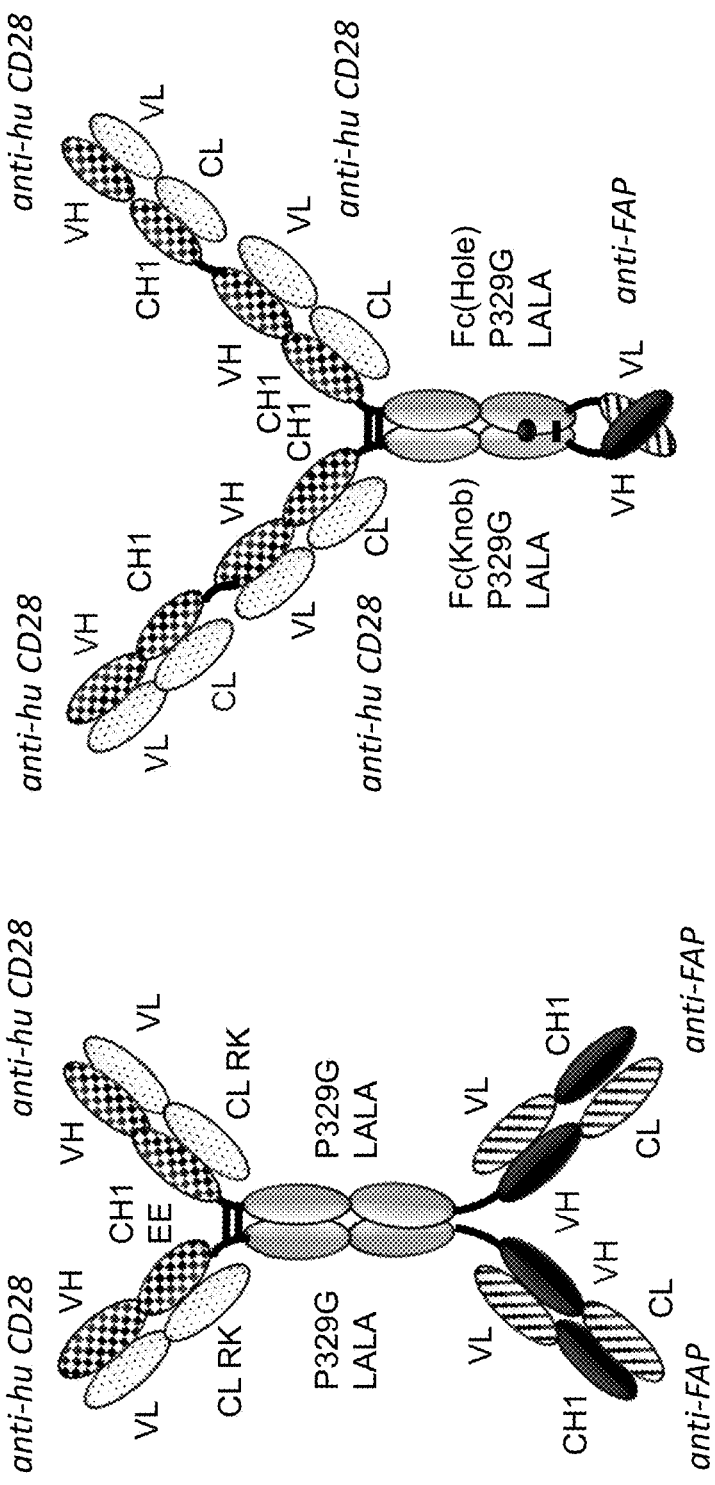

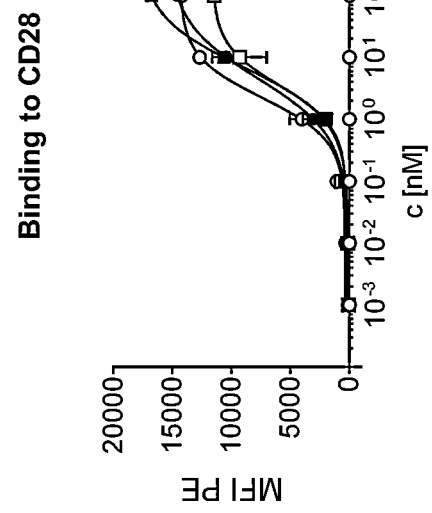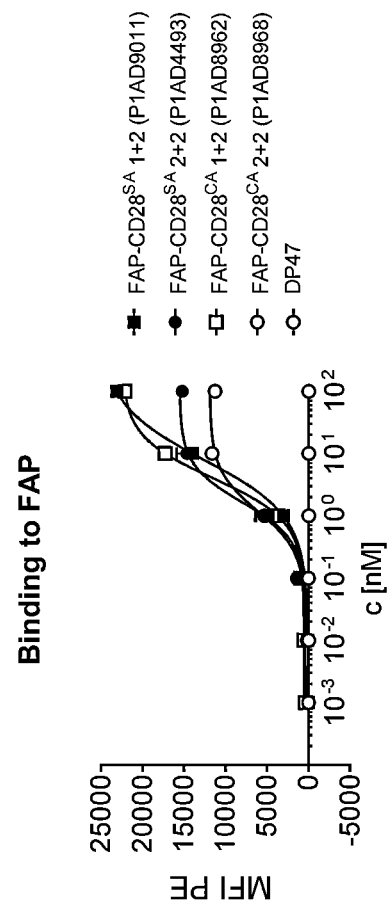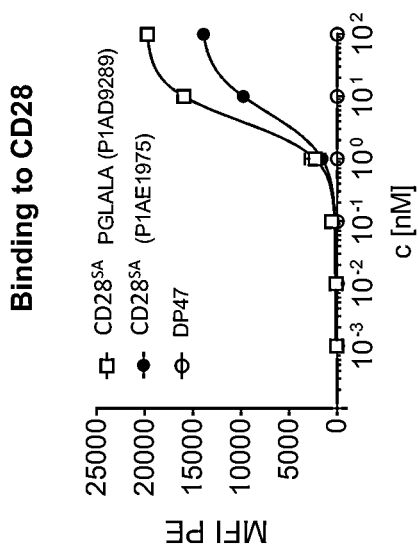

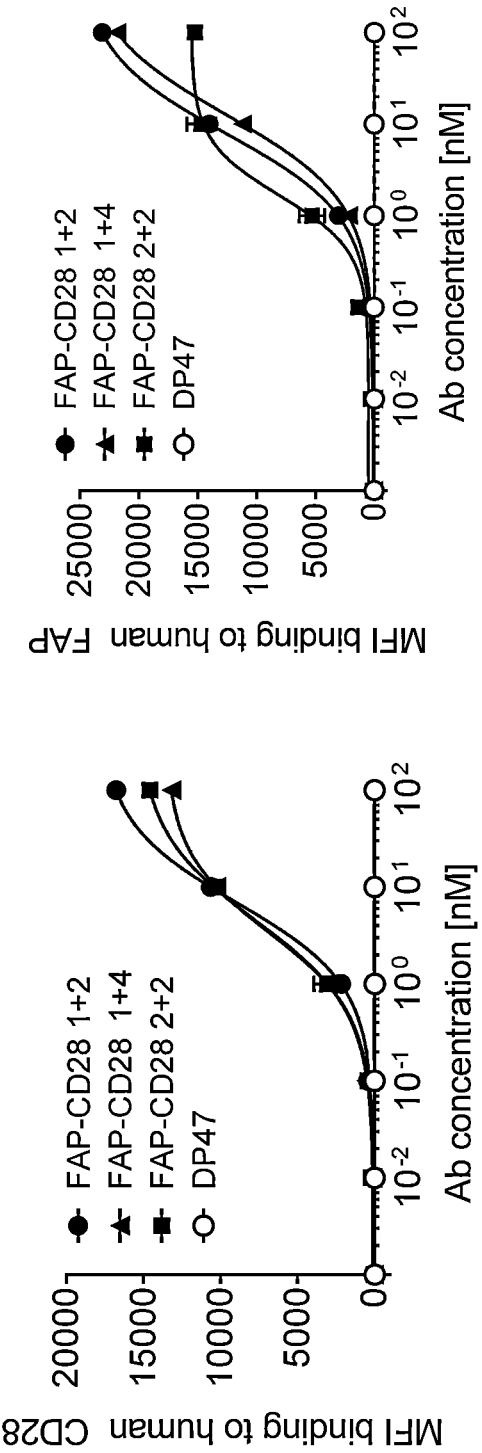

Fig. 3A, 3B, 3C, 3D: Sequence alignments of CD28 and Herceptin VH and VL variants with CDR1, CDR2, and CDR3 regions indicated. SEQ ID NOs: 26, 42–49 (VH variants a–h); 612, 50, 51 (VH variants i, j); 27, 52–60 (VL variants k–s); 613, 61 (VL variant t).

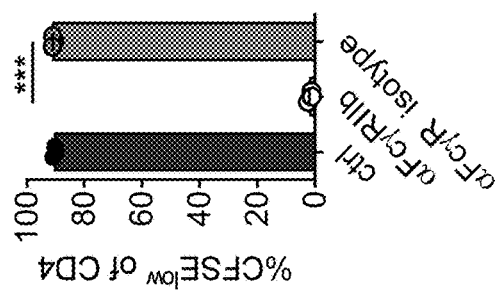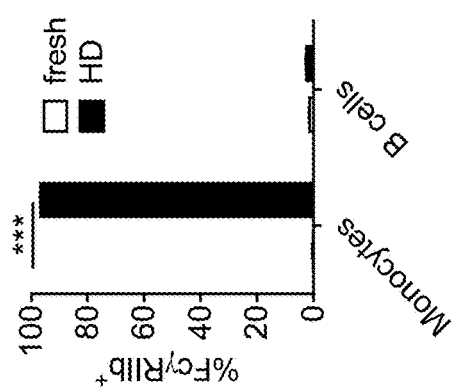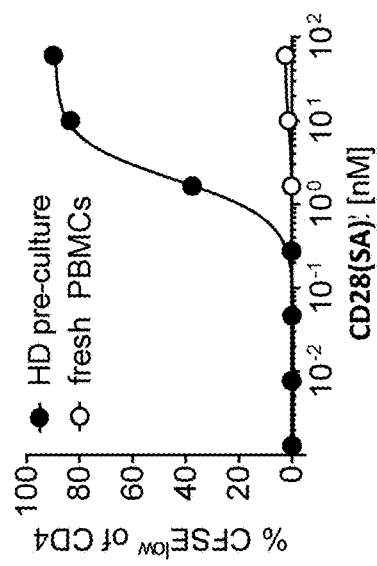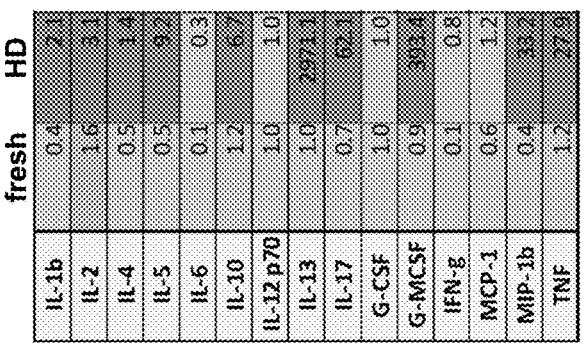

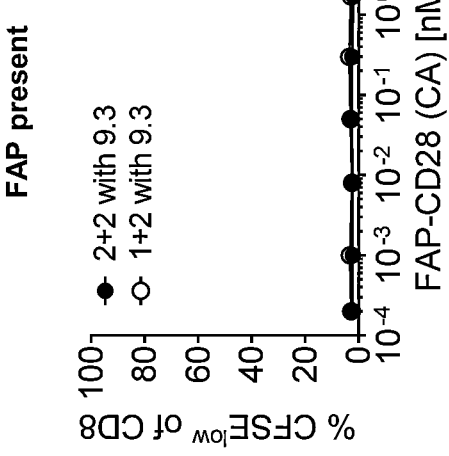
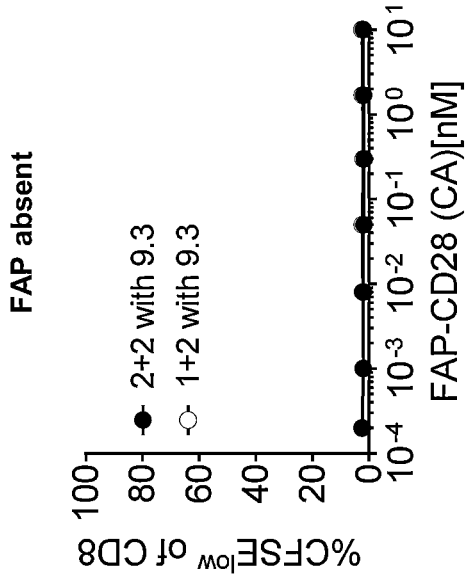
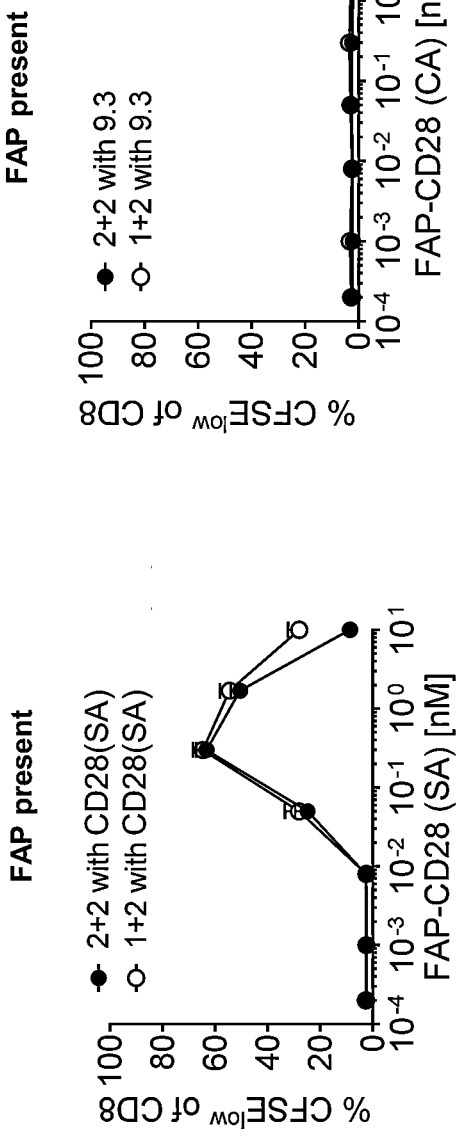
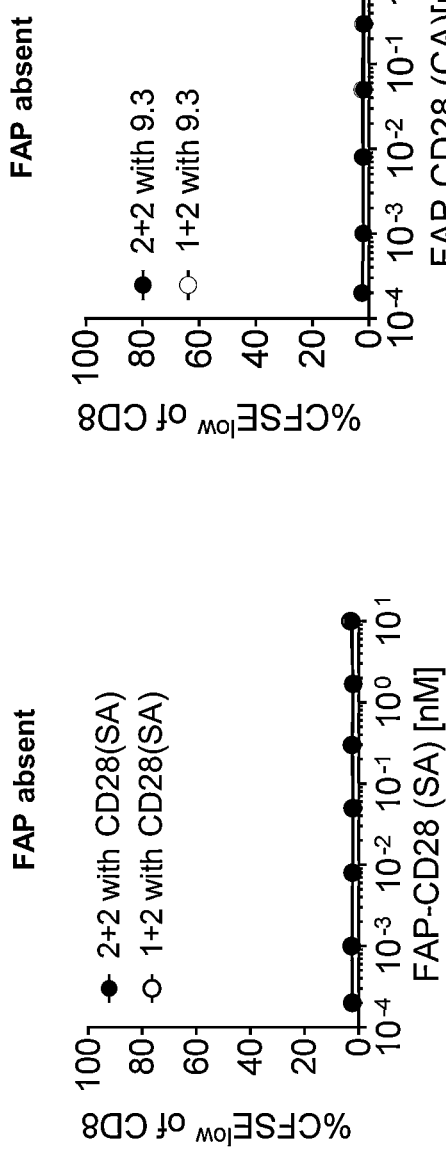

Fig. 7E

|  | FAP present ||||| FAP absent ||||| |
|  | SA 1+2 | SA 2+2 | CA 1+2 | CA 2+2 | SA 1+2 | SA 2+2 | CA 1+2 | CA 2+2 | UT |
|---|---|---|---|---|---|---|---|---|---|
| IL-1b | 20.7 | 28.5 | 4.0 | 1.3 | 1.1 | 1.4 | 0.9 | 0.8 | 1.0 |
| IL-2 | 7.3 | 6.0 | 0.6 | 0.4 | 0.6 | 0.6 | 0.6 | 1.0 | 1.0 |
| IL-4 | 6.1 | 5.3 | 1.6 | 0.9 | 0.9 | 0.9 | 0.9 | 1.0 | 1.0 |
| IL-5 | 8.5 | 6.3 | 1.8 | 0.8 | 0.9 | 0.9 | 0.8 | 0.9 | 1.0 |
| IL-6 | 29.3 | 26.6 | 5.7 | 0.6 | 0.4 | 0.5 | 0.2 | 0.3 | 1.0 |
| IL-10 | 8.2 | 3.8 | 1.7 | 1.1 | 1.6 | 1.1 | 0.8 | 1.1 | 1.0 |
| IL-12 p70 | 1.1 | 1.0 | 1.0 | 1.0 | 1.0 | 1.0 | 1.0 | 1.0 | 1.0 |
| IL-13 | 1230.5 | 744.2 | 2.3 | 1.0 | 3.0 | 2.1 | 1.0 | 1.0 | 1.0 |
| IL-17 | 58.4 | 47.0 | 2.5 | 0.8 | 0.9 | 1.5 | 0.6 | 0.8 | 1.0 |
| G-CSF | 3.9 | 9.3 | 2.0 | 1.0 | 1.0 | 1.0 | 1.0 | 1.0 | 1.0 |
| G-MCSF | 62.7 | 22.9 | 1.0 | 0.6 | 0.9 | 0.8 | 0.7 | 1.0 | 1.0 |
| IFN-g | 35.7 | 21.9 | 0.9 | 0.6 | 1.0 | 0.9 | 0.8 | 1.0 | 1.0 |
| MCP-1 | 0.8 | 0.6 | 0.9 | 0.5 | 0.9 | 0.9 | 0.8 | 0.9 | 1.0 |
| MIP-1b | 9.8 | 8.3 | 0.5 | 0.3 | 0.4 | 0.5 | 0.3 | 1.2 | 1.0 |
| TNF | 98.9 | 77.4 | 2.6 | 1.1 | 1.2 | 1.4 | 0.9 | 1.0 | 1.0 |

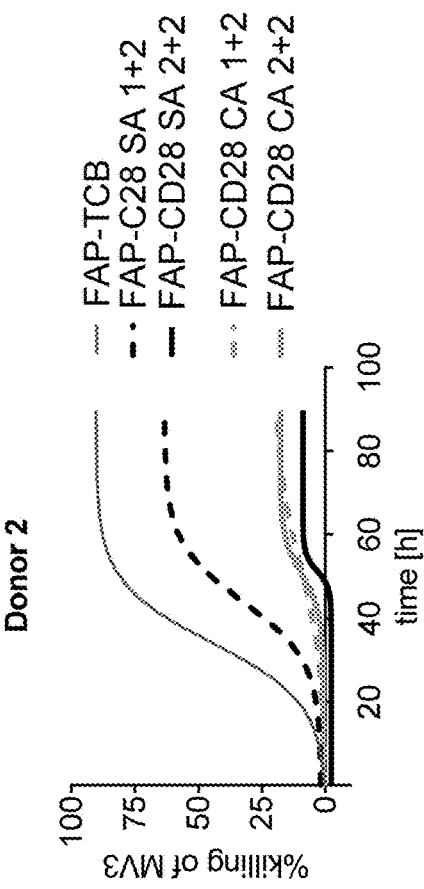
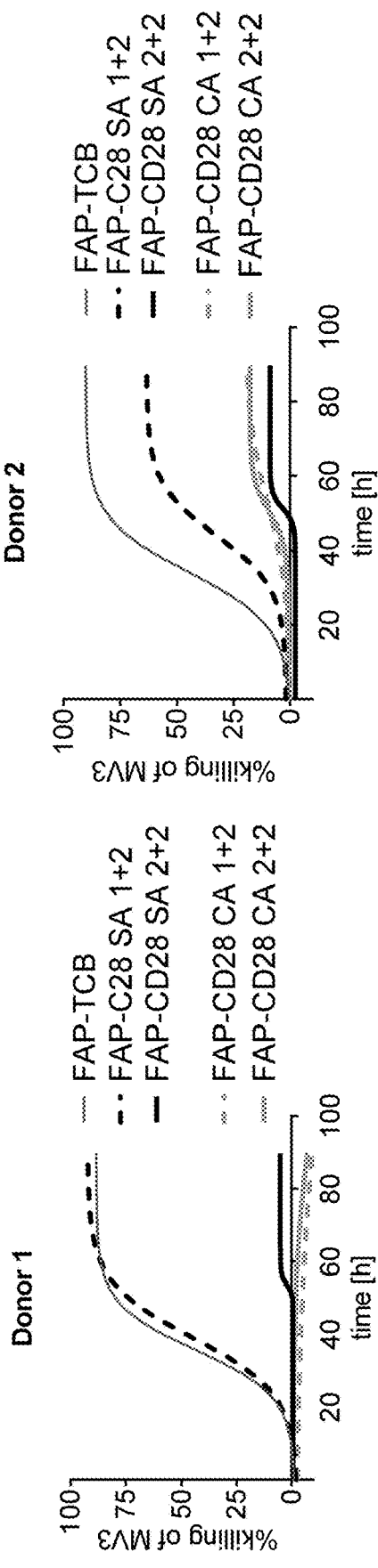
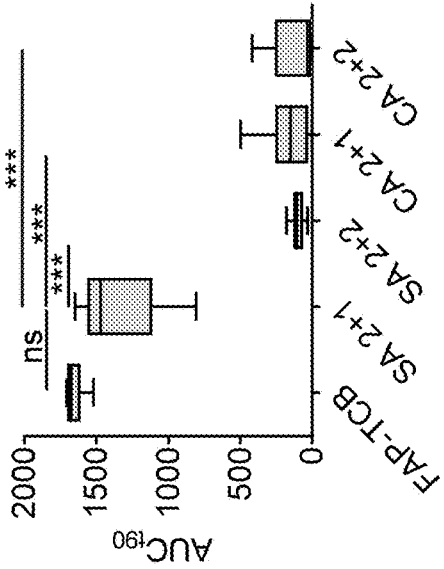
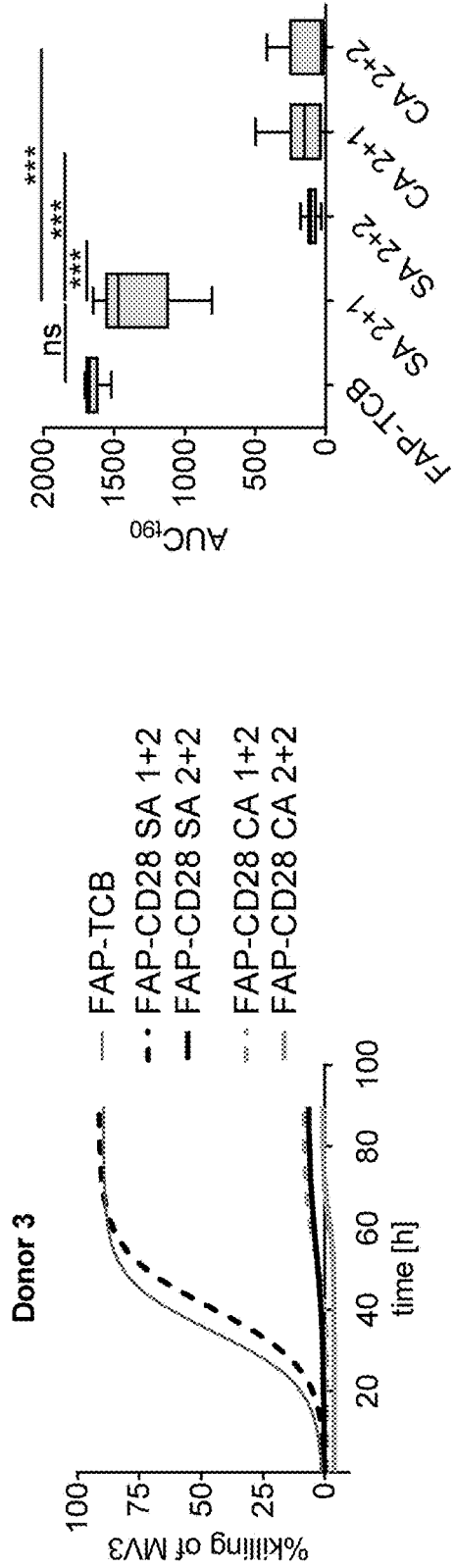

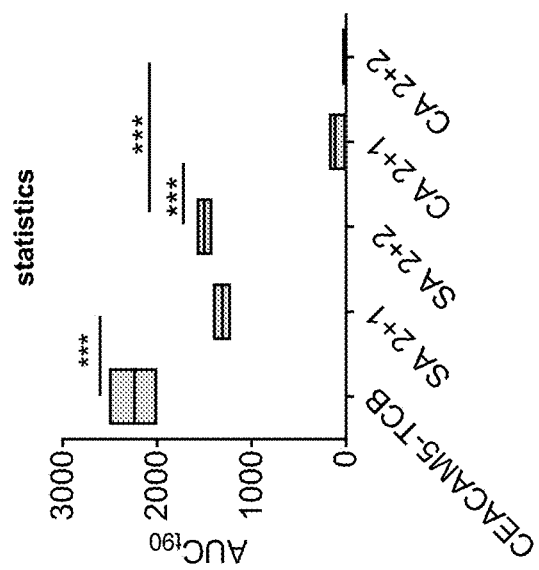
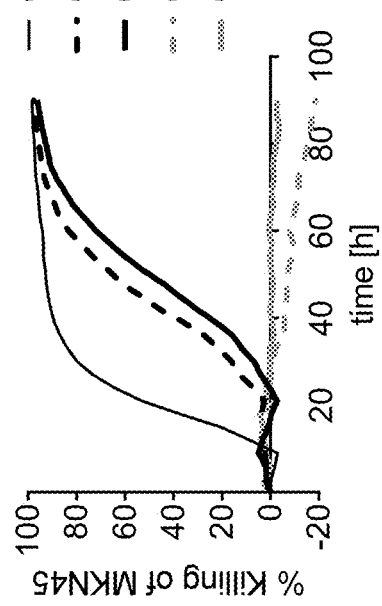
Fig. 9A
Fig. 9B

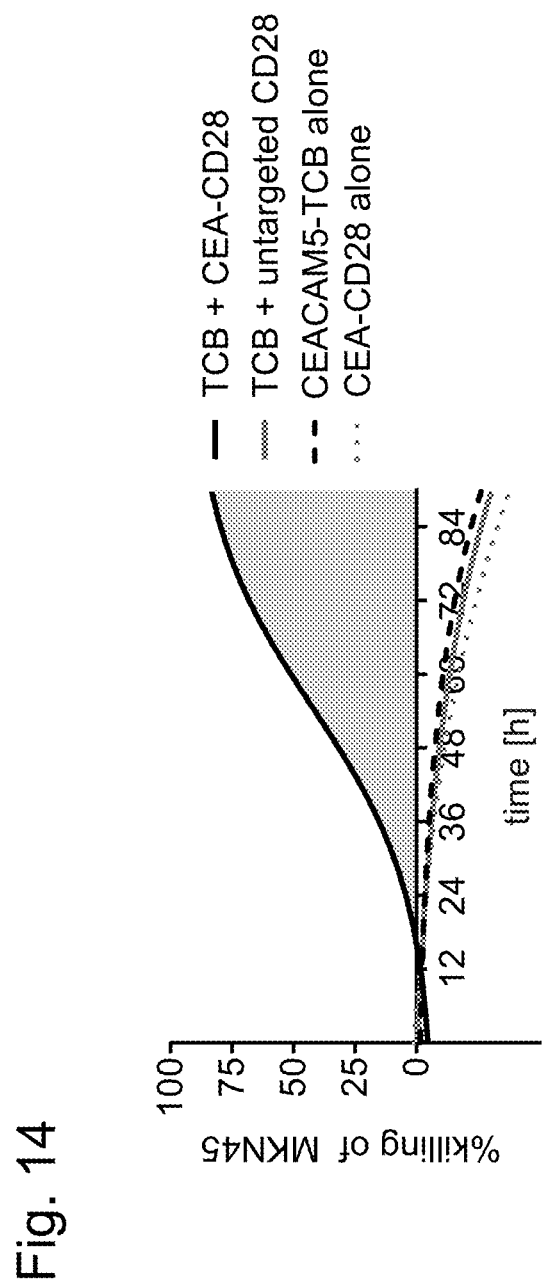

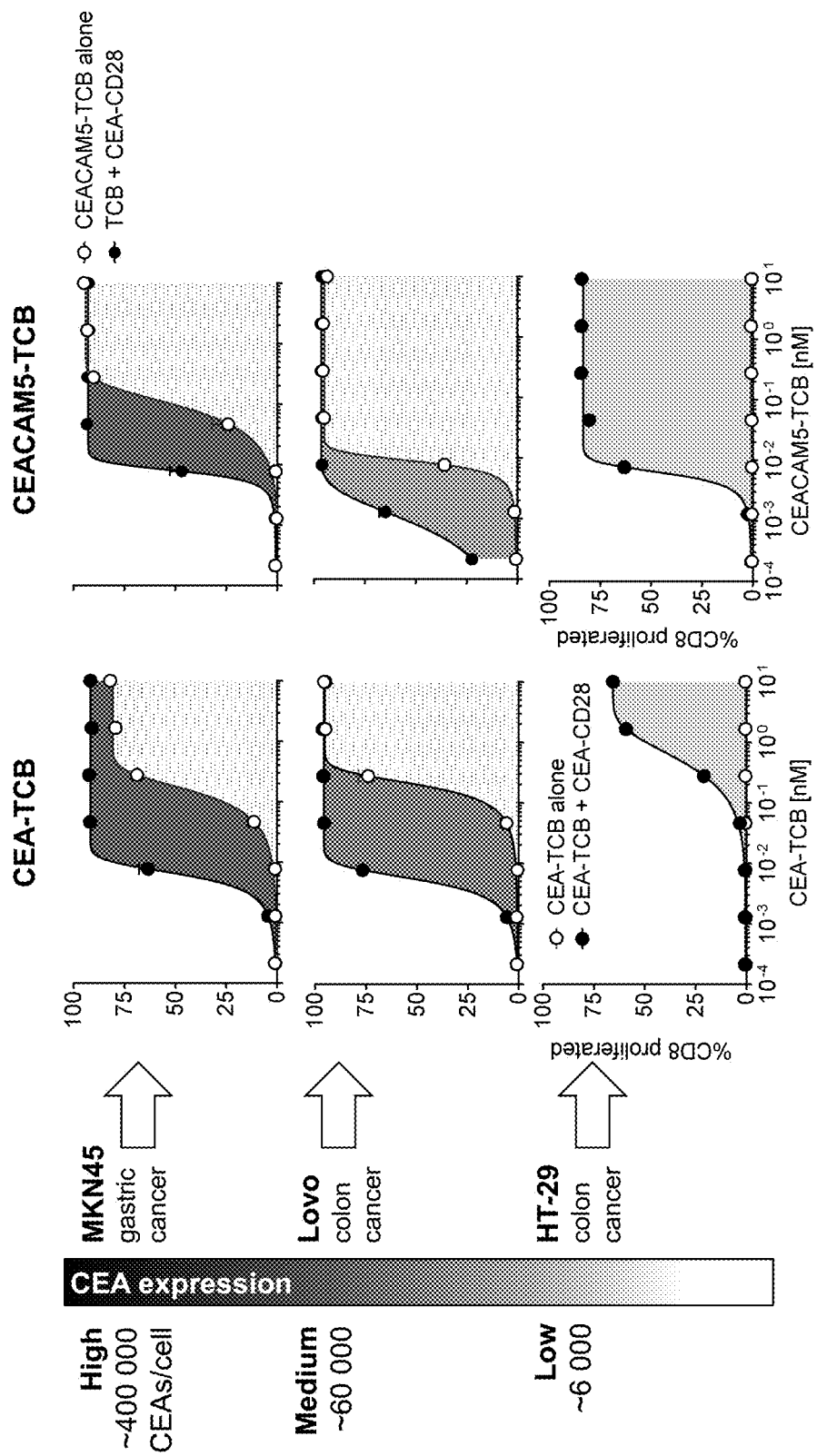

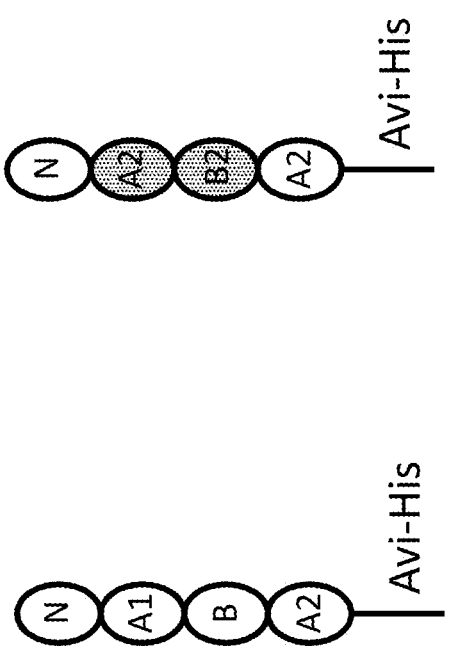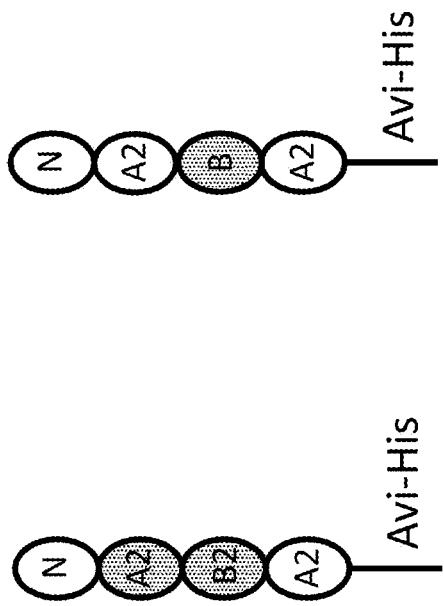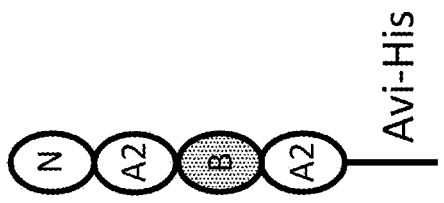

Fig. 20A

VH(A5H1El1D) SEQ ID NO: 186

EVQLLESGGG LVQPGGSLRL SCAASGFTFT DYYMNWVRQA PGKGLEWLGF IGNKANAYTT
X XXXX X

EYSASVKGRF TISRDKSKNT LYLQMNSLRA EDTATYCTR DRGLRFYEDY WGQGTTVTVSS
X XXXXX XXXXXXXXX

Fig. 20B

VL (A5H1El1D) SEQ ID NO: 187

EIVLTQSPAT LSLSPGERAT LSCRASSSVT YIHWYQQKPG QAPRSWIYAT SNLASGIPAR
X XXXXX X

FSGSGSGTDF TLTISSLEPE DFAVYYCQHW SSKPPTFGQG TKLEIK
XXXX X XXXXXXX

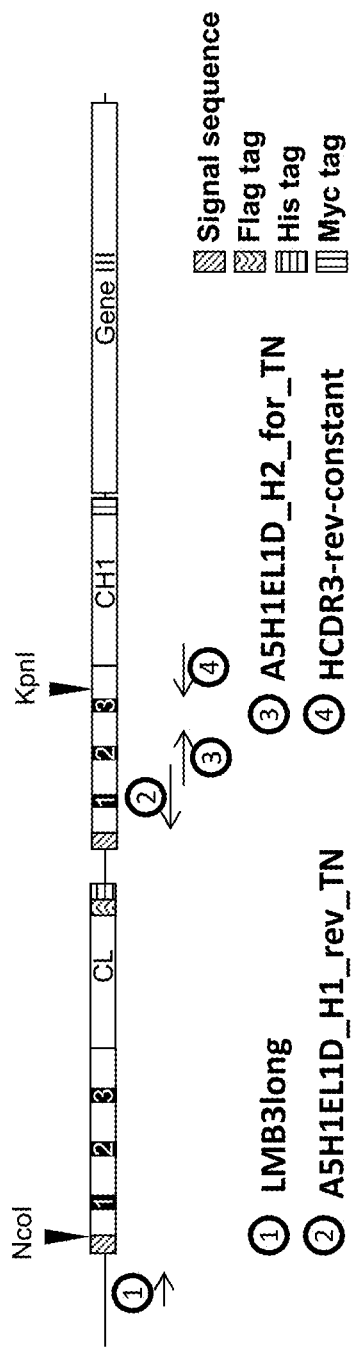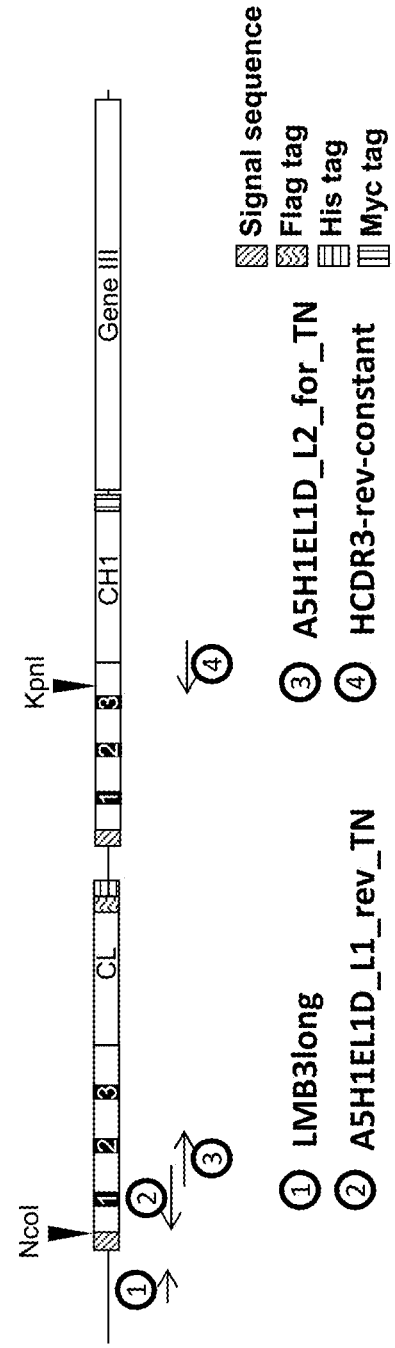

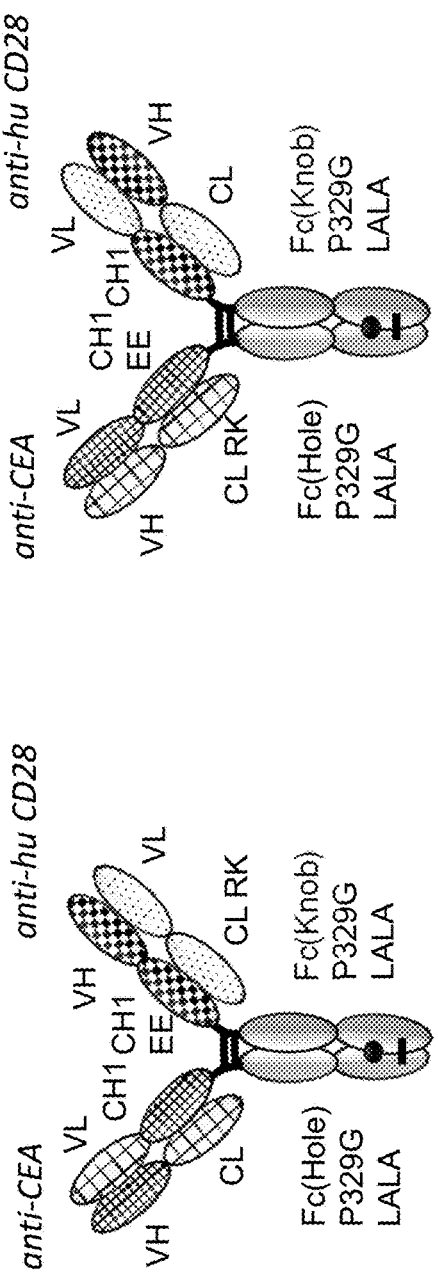
Fig. 23A
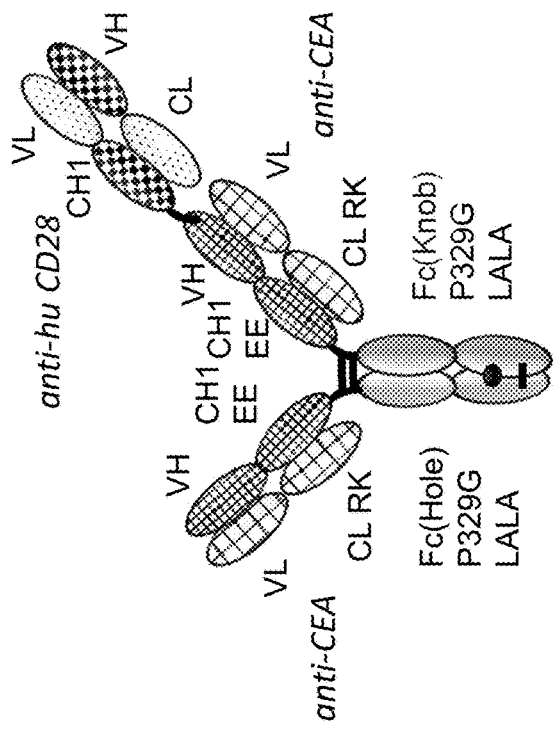
Fig. 23B
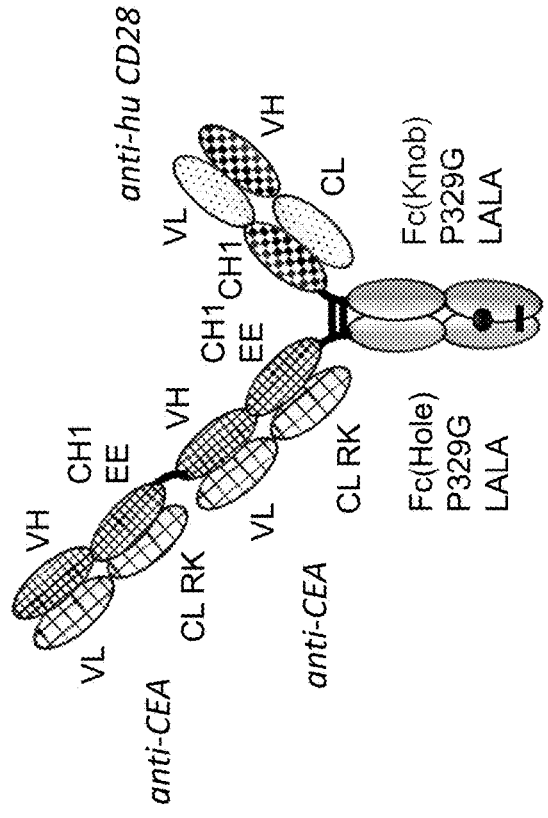
Fig. 23C
Fig. 23D

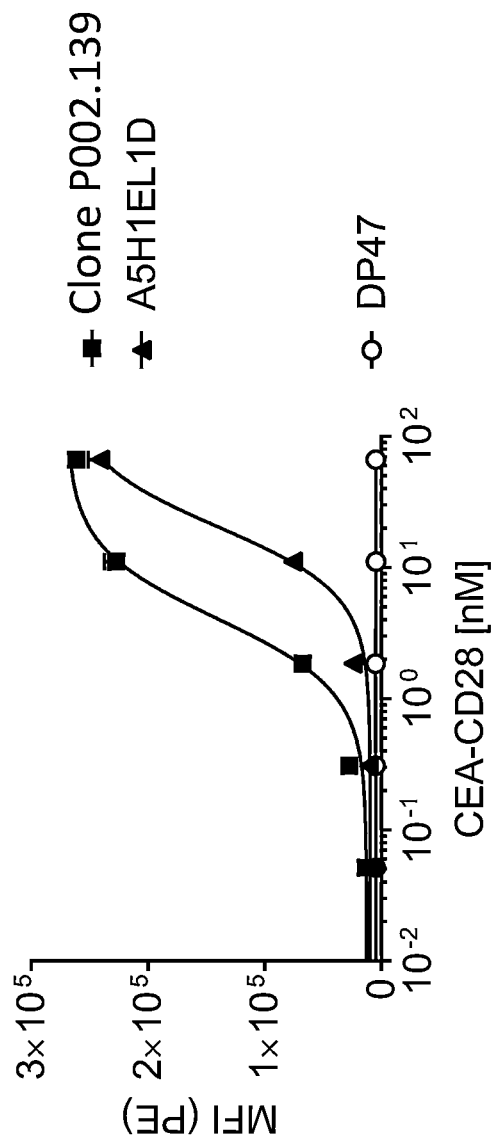

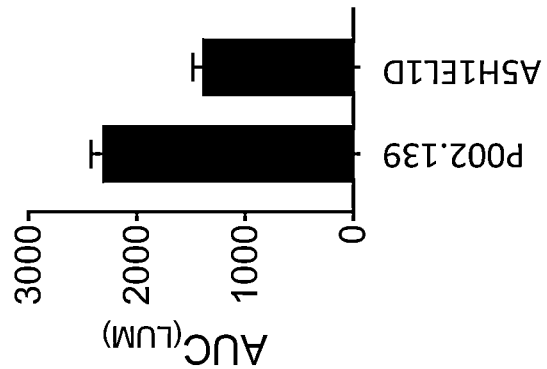
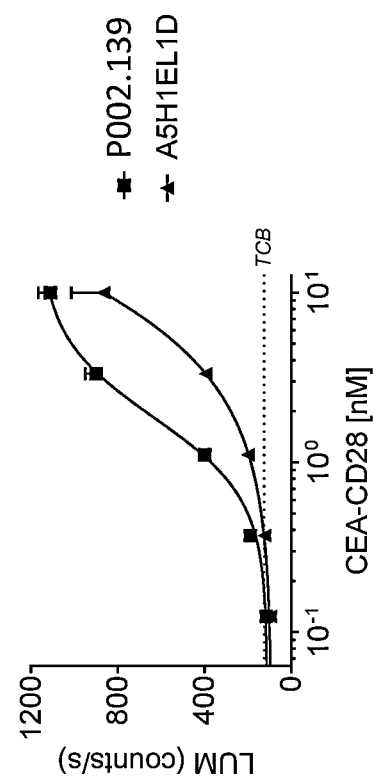
Fig. 25A
Fig. 25B

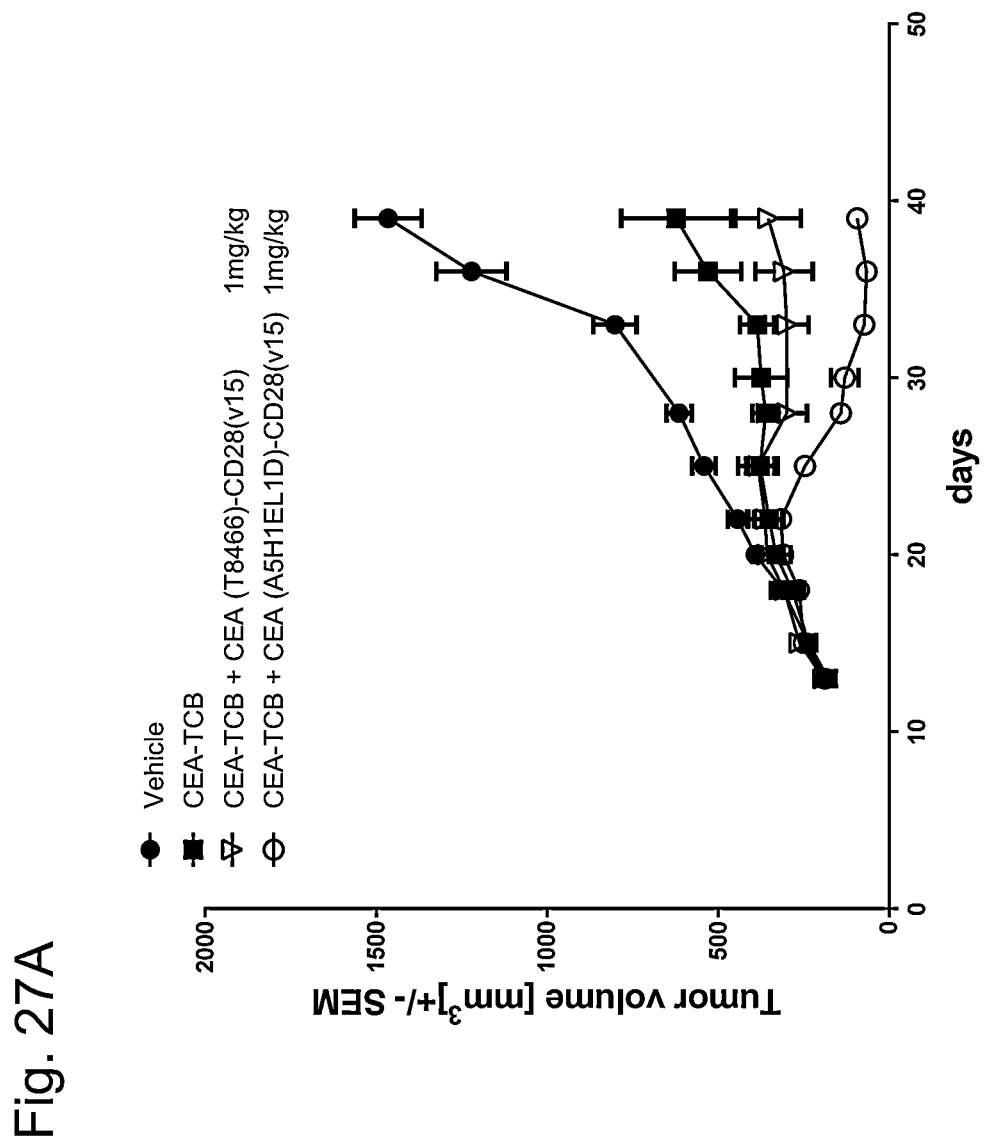

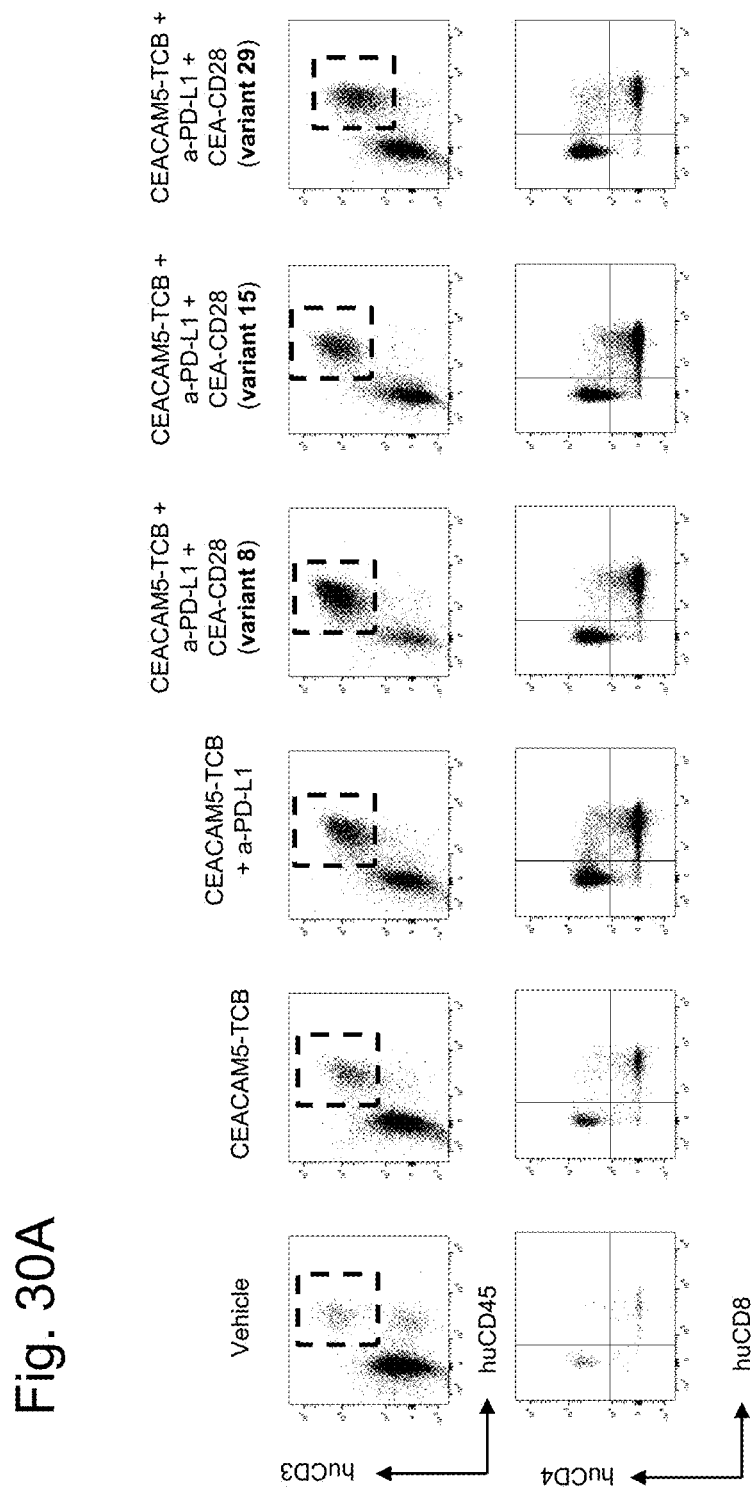

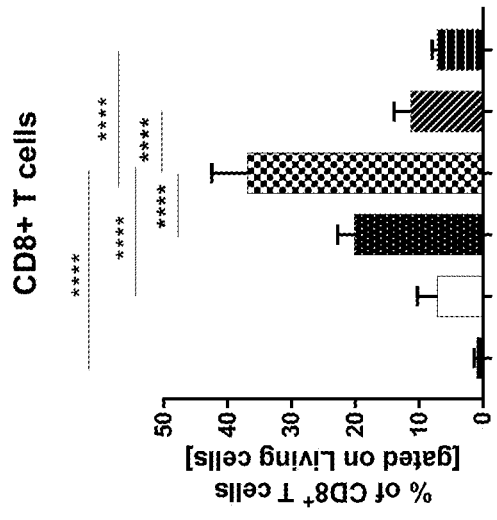
Fig. 30B
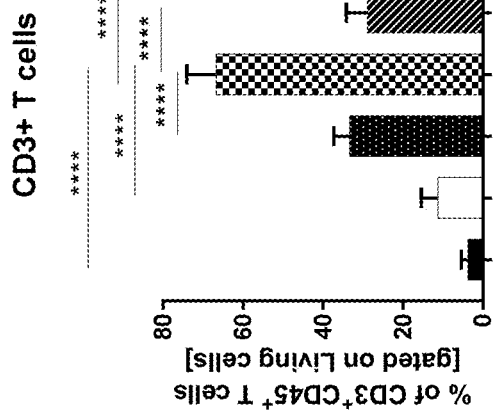
Fig. 30C
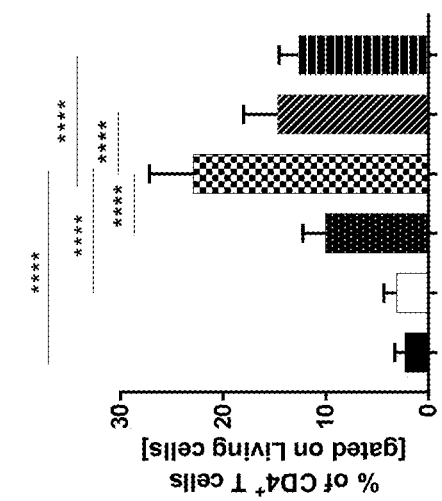
Fig. 30D
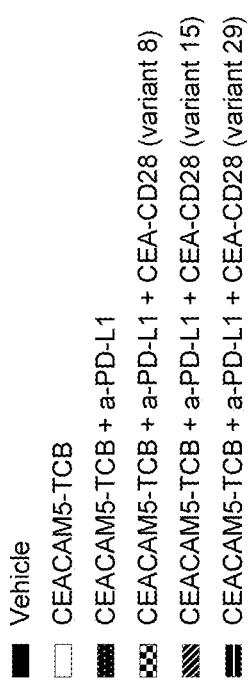

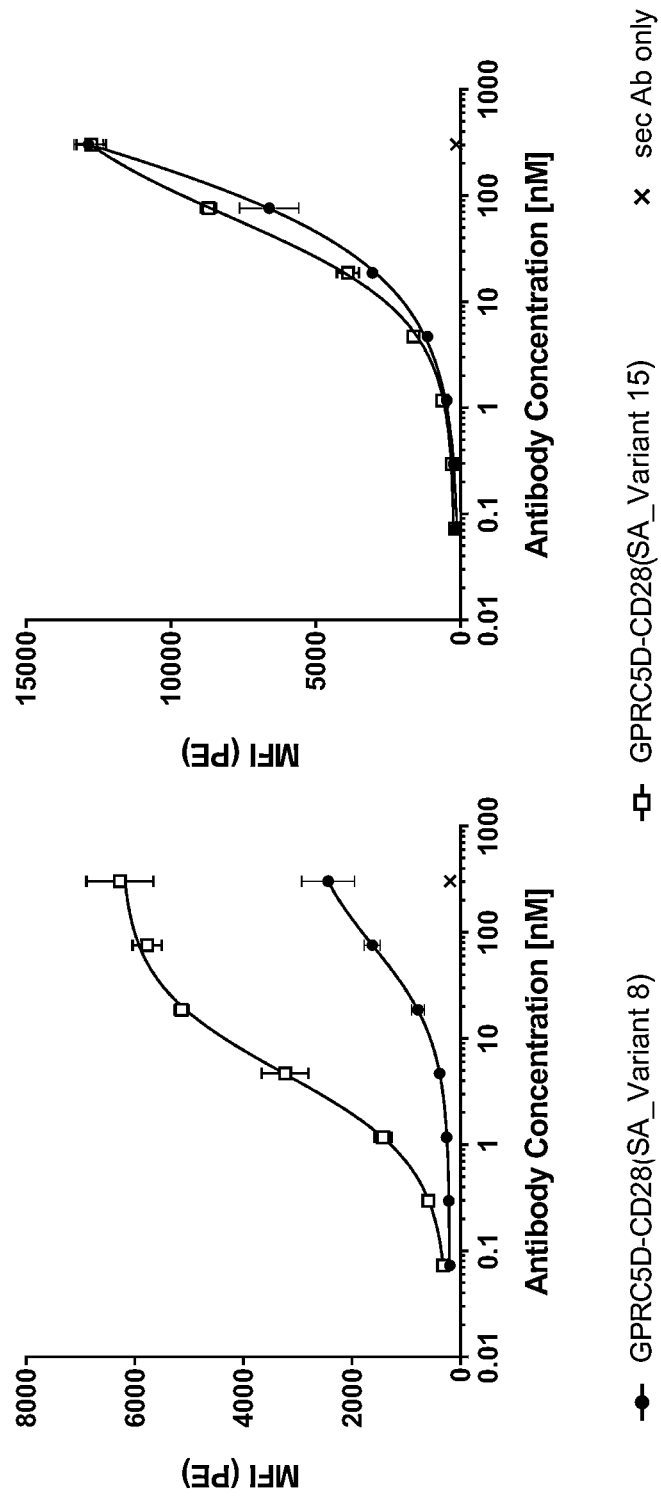

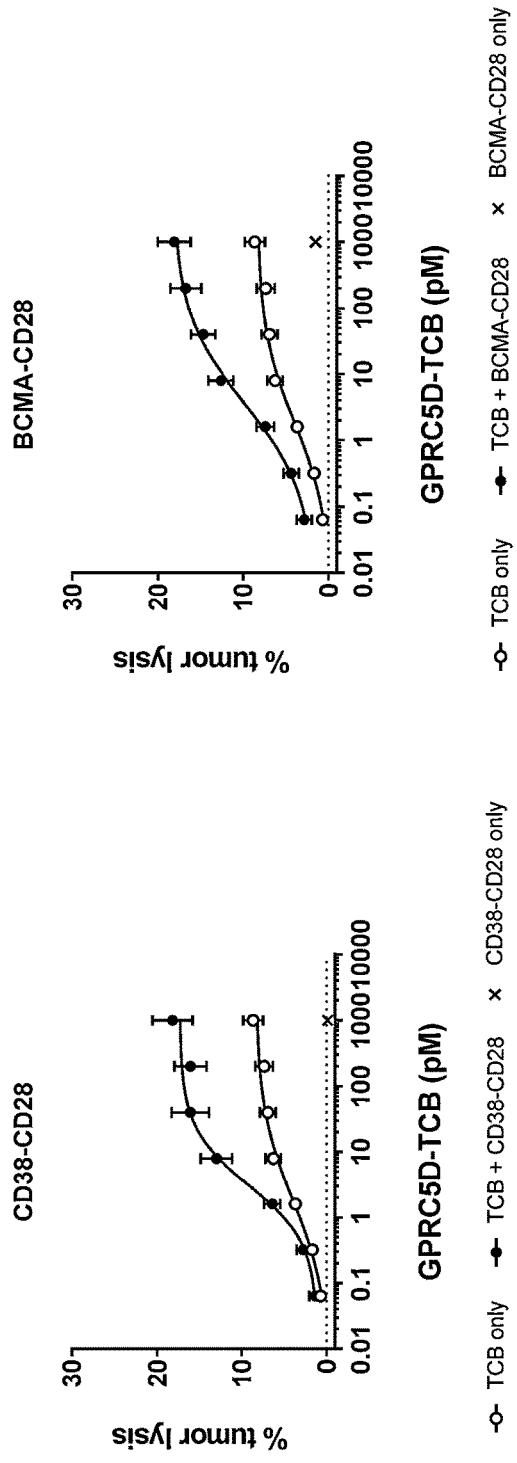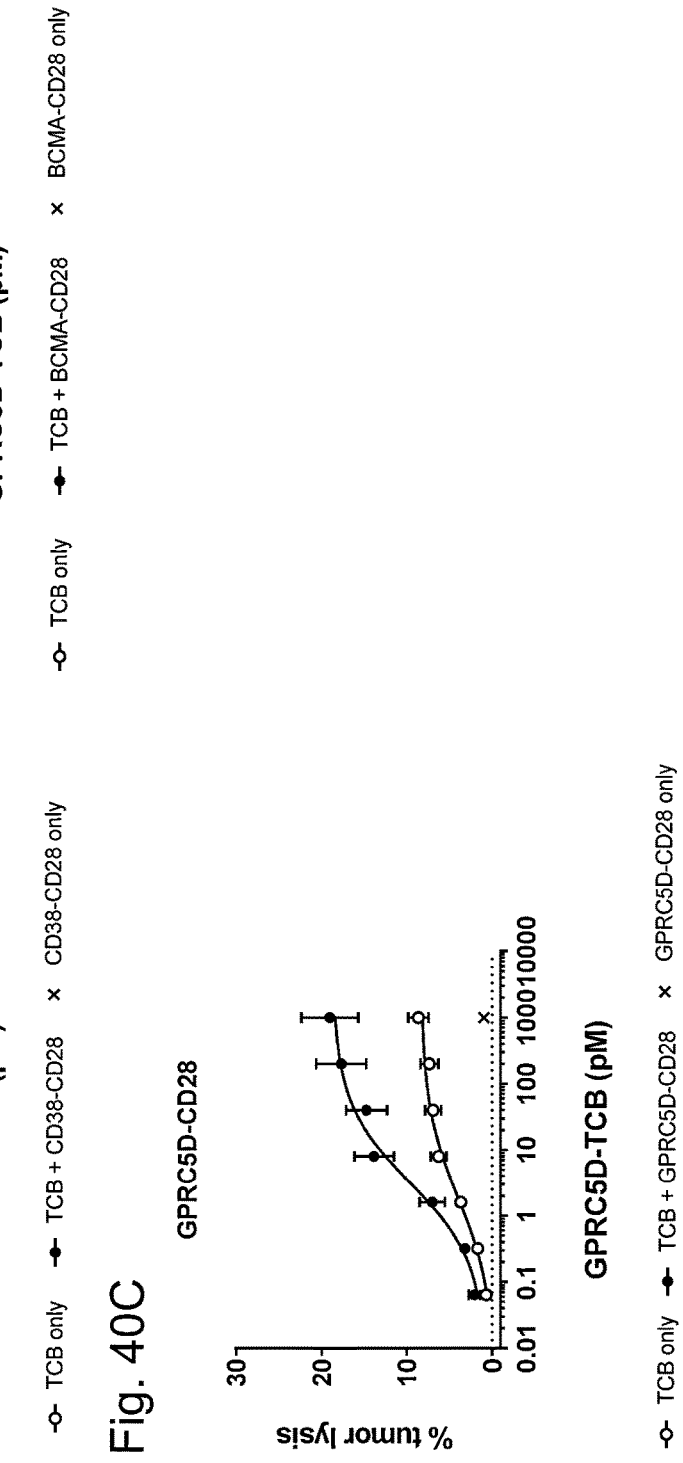

TUMOR-TARGETED AGONISTIC CD28 ANTIGEN BINDING MOLECULES

SEQUENCE LISTING

This application contains a Sequence Listing which has been submitted electronically in ASCII format and is hereby incorporated by reference in its entirety. Said ASCII copy, created on Dec. 16, 2019, is named P35128-US_SeqListing.txt and is 958,930 bytes in size and updated by a file entitled P35128_SeqLisitng_Replacment_2, created on Aug. 8, 2022, which is 961,083 bytes in size.

FIELD OF THE INVENTION

The present invention relates to tumor-targeted bispecific agonistic CD28 antigen binding molecules characterized by monovalent binding to CD28, methods for their production, pharmaceutical compositions containing these molecules, and their use as immunomodulators in the treatment of cancer.

BACKGROUND

Cancer immunotherapy is becoming an increasingly effective therapy option that can result in dramatic and durable responses in cancer types such as melanoma, non-small cell lung cancer and renal cell carcinoma. This is mostly driven by the success of several immune checkpoint blockades including anti-PD-1 (e.g. Keytruda, Merck; Opdivo, BMS), anti-CTLA-4 (e.g. Yervoy, BMS) and anti-PD-L1 (e.g. Tecentriq, Roche). These agents are likely to serve as standard of care for many cancer types, or as the backbone of combination therapies, however, only a fraction of patients (<25%) benefits from such therapies. Furthermore, various cancers (prostate cancer, colorectal cancer, pancreatic cancer, sarcomas, non-triple negative breast cancer etc.) present primary resistance to these immunomodulators. A number of reports indicate that the absence of pre-existing anti-tumor T cells contributes to the absence or poor response of some patients. In summary, despite impressive anti-cancer effects of existing immunotherapies, there is a clear medical need for addressing a large cancer patient population and for developing therapies that aim to induce and enhance novel tumor-specific T cell responses.

CD28 is the founding member of a subfamily of costimulatory molecules characterized by paired V-set immunoglobulin superfamily (IgSF) domains attached to single transmembrane domains and cytoplasmic domains that contain critical signaling motifs (Carreno and Collins, 2002). Other members of the subfamily include ICOS, CTLA-4, PD1, PD1H, TIGIT, and BTLA (Chen and Flies, 2013). CD28 expression is restricted to T cells and prevalent on all naïve and a majority of antigen-experienced subsets, including those that express PD-1 or CTLA-4. CD28 and CTLA-4 are highly homologous and compete for binding to the same B7 molecules CD80 and CD86, which are expressed on dendritic cells, B cells, macrophages, and tumor cells (Linsley et al., 1990). The higher affinity of CTLA-4 for the B7 family of ligands allows CTLA-4 to outcompete CD28 for ligand binding and suppress effector T cells responses (Engelhardt et al., 2006). In contrast, PD-1 was shown to inhibit CD28 signaling by in part dephosphorylating the cytoplasmic domain of CD28 (Hui et al., 2017). Ligation of CD28 by CD80 or CD86 on the surface of professional antigen-presenting cells is strictly required for functional de novo priming of naïve T cells, subsequent clonal expansion, cytokine production, target cell lysis, and formation of long-lived memory. Binding of CD28 ligands also promotes the expression of inducible co-stimulatory receptors such as OX-40, ICOS, and 4-1BB (reviewed in Acuto and Michel, 2003). Upon ligation of CD28, a disulfide-linked homodimer, the membrane proximal YMNM motif and the distal PYAP motif have been shown to complex with several kinases and adaptor proteins (Boomer and Green, 2010). These motifs are important for the induction of IL2 transcription, which is mediated by the CD28-dependent activation of NFAT, AP-1, and NFκB family transcription factors (Fraser et al., 1991) (June et al., 1987) (Thompson et al., 1989). However, additional poorly characterized sites for phosphorylation and ubiquitination are found within the cytoplasmic domain of CD28. As reviewed by (Esensten et al., 2016), CD28-initiated pathways have critical roles in promoting the proliferation and effector function of conventional T cells. CD28 ligation also promotes the anti-inflammatory function of regulatory T cells. CD28 co-stimulates T cells by in part augmenting signals from the T cell receptor, but was also shown to mediate unique signaling events (Acuto and Michel, 2003; Boomer and Green, 2010; June et al., 1987). Signals specifically triggered by CD28 control many important aspects of T cell function, including phosphorylation and other post-translational modifications of downstream proteins (e.g., PI3K mediated phosphorylation), transcriptional changes (eg. Bcl-xL expression), epigenetic changes (e.g. IL-2 promoter), cytoskeletal remodeling (e.g. orientation of the microtubule-organizing center) and changes in the glycolytic rate (e.g. glycolytic flux). CD28-deficient mice have reduced responses to infectious pathogens, allograft antigens, graft-versus-host disease, contact hypersensitivity and asthma (Acuto and Michel, 2003). Lack of CD28-mediated co-stimulation results in reduced T cell proliferation in vitro and in vivo, in severe inhibition of germinal-centre formation and immunoglobulin isotype-class switching, reduced T helper (Th)-cell differentiation and the expression of Th2-type cytokines. CD4-dependent cytotoxic CD8+ T-cell responses are also affected. Importantly, CD28-deficient naïve T cells showed a reduced proliferative response particularly at lower antigen concentrations. A growing body of literature supports the idea that engaging CD28 on T cells has anti-tumor potential. Recent evidence demonstrates that the anti-cancer effects of PD-L1/PD-1 and CTLA-4 checkpoint inhibitors depend on CD28 (Kamphorst et al., 2017; Tai et al., 2007). Clinical studies investigating the therapeutic effects of CTLA-4 and PD-1 blockade have shown exceptionally promising results in patients with advanced melanoma and other cancers. In addition, infusion of genetically engineered T cells expressing artificial chimeric T cell receptors comprising an extracellular antigen recognition domain fused to the intracellular TCR signaling domains (CD3z) and intracellular co-stimulatory domains (CD28 and/or 4-1BB domains) has shown high rates and durability of response in B cell cancers and other cancers.

CD28 agonistic antibodies can be divided into two categories: (i) CD28 superagonistic antibodies and (ii) CD28 conventional agonistic antibodies. Normally, for the activation of naïve T cells both engagement of the T cell antigen receptor (TCR, signal 1) and costimulatory signaling by CD28 (signal 2) is required. CD28 Superagonists (CD28SA) are CD28-specific monoclonal antibodies, which are able to autonomously activate T cells without overt T cell receptor engagement (Hunig, 2012). In rodents, CD28SA activates conventional and regulatory T cells. CD28SA antibodies are therapeutically effective in multiple models of autoimmunity, inflammation and transplantation. However, a phase I study of the human CD28SA antibody TGN1412 resulted in a life-threatening cytokine storm in 2006. Follow-up studies have suggested that the toxicity was caused by dosing errors due to differences in the CD28 responsiveness of human T cells and T cells of preclinical animal models. TGN1412 is currently being re-evaluated in an open-label, multi-center dose escalation study in RA patients and patients with metastatic or unresectable advanced solid malignancies. CD28 conventional agonistic antibodies, such as clone 9.3, mimic CD28 natural ligands and are only able to enhance T cell activation in presence of a T cell receptor signal (signal 1). Published insights indicate that the binding epitope of the antibody has a major impact on whether the agonistic antibody is a superagonist or a conventional agonist (Beyersdorf et al., 2005). The superagonistic TGN1412 binds to a lateral motif of CD28, while the conventional agonistic molecule 9.3 binds close to the ligand binding epitope. As a consequence of the different binding epitopes, superagonistic and conventional agonistic antibodies differ in their ability to form linear complexes of CD28 molecules on the surface of T cells. Precisely, TGN1412 is able to efficiently form linear arrays of CD28, which presumably leads to aggregated signaling components which are sufficient to surpass the threshold for T cell activation. The conventional agonist 9.3, on the other hand, leads to complexes which are not linear in structure. An attempt to convert conventional agonistic binders based on the 9.3 clone has been previously published (Otz et al., 2009) using a recombinant bi-specific single-chain antibody directed to a melanoma-associated proteoglycan and CD28. The reported bispecific single chain antibody was reported to exert "supra-agonistic" activity despite the use of a conventional CD28 agonistic binder 9.3, based in the intrinsic tendency of bispecific single chain antibodies to form multimeric constructs.

It has been found that a better T cell activation is achieved when limiting amounts of anti-CD3 bispecific antibodies, i.e. T cell bispecific antibodies (TCBs) such as CEA-TCB, are combined with agonistic anti-CD28 molecules. Given, that CD28 is expressed at baseline on T cells in various tumor indications (Lavin et al., 2017; Tirosh et al., 2016, Zheng et al., 2017) and activation of CD28 signaling enhances T cell receptor signals, the combination of a TCB molecule with a tumor-targeted CD28 molecule is expected to act synergistically to induce strong and long-lasting anti-tumor responses. Thus, we herein describe novel tumor-targeted agonistic CD28 molecules which display synergy with TCBs and require CD28 binding monovalency for strict tumor target dependence in the presence of TCB signals.

Immunotherapy of Solid Tumors

The treatment of solid tumors is an ongoing challenge, with little advancements seen over the last years. Typically, the treatment will be a combination of surgery and chemotherapy and/or radiotherapy. While quite a few new treatment modalities have been developed recently, there is still a need for further improvements, to increase survival rates of patients suffering from solid tumors, and improve their quality of life. Solid tumors rarely express one tumor specific antigen. For most solid tumors, it is more common to find a tumor associated antigen (TAA) that is enriched on tumors but also expressed at very low levels on normal tissues. The TAA is preferably presented on the surface of the solid tumor cell or on a cell of the tumor stroma. This is the case for many frequently targeted TAAs for solid tumors, including Fibroblast Activation Protein (FAP), Carcinoembryonic Antigen (CEA), Folate receptor alpha (FolR1), Melanoma-associated Chondroitin Sulfate Proteoglycan (MCSP), Epidermal Growth Factor Receptor (EGFR), human epidermal growth factor receptor 2 (HER2) and p95HER2. Further TAAs include HER3, EpCAM, TPBG (5T4), mesothelin, MUC1, and PSMA. Bispecific agonistic CD28 antigen binding molecule comprising an antigen binding domain that specifically binds to a tumor associated antigen will thus be directed primarily to the tumor surface or tumor microenvironment and will specifically activate T cells in the proximity of the tumor while a systemic activation may be avoided.

Rationale for Targeting CD28 Agonism to B Cell Malignancies

Non-Hodgkin's lymphoma (NHL) is one of the leading causes of cancer death in the United States and in Europe. Follicular lymphoma (FL) is indolent in its course and has a slow rate of evolution, with a median survival of 8 to 10 years; patients in advanced clinical stages usually are not curable. Likewise, in 2% to 3% of patients per year, the phenotype of FL can transform into an aggressive, large cell lymphoma, a critical event in the course of the disease and one that is associated with increased lymphoma-related mortality. Mantle cell lymphoma and diffuse large B cell lymphoma (DLBCL) are more aggressive and, if untreated, have a median survival rate of only 6 months. The lack of curative outcomes for many patients with both indolent and aggressive NHL subtypes remains an unmet medical need, despite significant advances in immune-therapeutics that have extended progression free-survival times. During the past several years, significant prolonged survival in DLBCL has been observed, particularly with the addition of the anti-CD20 monoclonal antibody, rituximab (Rittman®, MabThera®) to intensive cytotoxic chemotherapeutic regimens. However, despite conventional treatment for previously untreated DLBCL is curative in intent, the majority of patients will eventually relapse. Likewise, advanced FL remains largely incurable by current SoC and is characterized by repeated relapses and progressively shorter remissions. Currently, many new generation monoclonal antibodies are in different preclinical and clinical phases of assessment to further improve the outcome of NHL patients and overcome mechanisms of rituximab resistance. High dose chemotherapy with autologous stem cell support or allogeneic stem cell transplantation provides a curative option for only a minority (10%) of patients with relapsed/refractory (r/r) DLBCL and is associated with substantial treatment-related mortality. Other approaches for the treatment of NHL currently in development include molecular targeted compounds like venetoclax and BET-inhibitors. Recently approved novel agents include lenalidomide, idelalisib, and copanlisib. Chimeric antigen receptor (CAR) T-cell therapy has been approved for the treatment of aggressive forms of r/r B-NHL, but this therapy is available only in limited settings and can be associated with fatal neurologic events and cytokine release syndrome (CRS). Bispecific antibody constructs redirecting the lysis of cytotoxic cells to malignant B cells are currently in development and have shown very promising efficacy against NHL. Chemotherapy-free treatments are envisioned for the future of NHL and will likely be based on bispecific antibodies or chimeric antigen receptor T cells (CAR T cells). A CD28 agonist targeted against a B cell surface antigen in combination with immunotherapy shall enhance the survival and/or cure rates for patients with B cell malignancies, without compromising their quality of life.

B Cell Surface Antigens as a Target for B Cell Malignancies

TAAs related to B cell malignancies are B cell surface antigens. The human CD19 antigen is a 95 KDa transmembrane glycoprotein belonging to the immunoglobulin superfamily. CD19 is classified as a type I transmembrane protein, with a single transmembrane domain, a cytoplasmic C-terminus, and extracellular N-terminus. In normal cells, it is the most ubiquitously expressed protein in the B lymphocyte lineage. CD19 expression is maintained in B-lineage cells that have undergone neoplastic transformation, and therefore CD19 is useful in diagnosis of leukemias and lymphomas using monoclonal antibodies (mAbs) and flow cytometry, so does the CD20 antigen. Because B lineage leukemias and lymphomas rarely lose CD19 expression, and because it is not expressed in the pluripotent stem cell, it has become the target for a variety of immunotherapeutic agents, including immunotoxins. CD79 is the signaling component of the B-cell receptor consisting of a covalent heterodimer containing CD79a (Igα, mb-1) and CD79b (Igβ, B29). CD79a and CD79b each contain an extracellular immunoglobulin (Ig) domain, a transmembrane domain, and an intracellular signaling domain, an immunoreceptor tyrosine-based activation motif (ITAM) domain, like other signalling proteins such as CD3 or activatory Fcγ receptor. CD79a and CD79b are thus transmembrane proteins that compose the signalling subunits of the B cell receptor (BCR). CD79b is a 39 KDa protein exclusively expressed on B cells and, in cooperation with CD79a, initiates the signal transduction cascade downstream of the BCR, which leads to internalization of the BCR complex, its translocation to the endosomes, and antigen presentation. In B cells, antigen-induced BCR clustering triggers tyrosine phosphorylation of the ITAM of CD79a and CD79b by Src kinases. This leads to the recruitment and activation of an array of effector molecules belonging to the BCR signalling cascade, including the most notable SYK and BLNK. Further downstream, recruitment of PLCg2, Btk, and ERK facilitate calcium flux and activate the B cells, which are then ready to receive additional co-activating signals that will drive their proliferation and differentiation into memory or effector cells. During this process, B cells become robust APCs and release cytokines that can influence the outcome and quality of the immune response. In addition to their role in BCR signalling, the CD79 subunits are also essential for the transport and display of membrane-bound Ig from the endoplasmic reticulum to the cell surface. The average surface expression of CD79b on NHLs is similar to that on normal B-cells, but with a greater range. Given the expression of CD79b, it is beneficial to produce therapeutic antibodies to the CD79b antigen that create minimal or no antigenicity when administered to patients, especially for chronic treatment.

It has been found that a better T cell activation is achieved when limiting amounts of anti-CD3 bispecific antibodies, i.e. T cell bispecific antibodies (TCBs) such as for example a CD20/CD3 bispecific antibody, are combined with agonistic anti-CD28 molecules. Given, that CD28 is expressed at baseline on T cells in various tumor indications (Lavin et al., 2017; Tirosh et al., 2016, Zheng et al., 2017) and activation of CD28 signaling enhances T cell receptor signals, the combination of T cell bispecific antibodies with bispecific agonistic CD28 antigen binding molecules targeting a B cell surface antigen is expected to act synergistically to induce strong and long-lasting anti-tumor responses. Thus, we herein describe novel bispecific agonistic CD28 antigen binding molecules targeting a B cell surface antigen which display synergy with TCBs and require CD28 binding monovalency for strict tumor target dependence in the presence of TCB signals.

Immunotherapy in Multiple Myeloma

Affecting ~75,000 new patients every year in the EU and US, multiple myeloma (MM) is one of the most common hematological malignancies with remaining high unmet medical need. Multiple myeloma is characterized by terminally differentiated plasma cells that secrete non-functional monoclonal immunoglobulins. In the short-term, the immunomodulatory drugs such as lenalidomide and pomalidomide, and proteasome inhibitors such as carfilzomib or bortezomib may remain the backbone of 1st line therapy for multiple myeloma (Moreau et al, 2016). However, these drugs do not target specifically the diseased tumor cells e.g. diseased plasma cells (PC). Efforts have been made towards selectively depleting the plasma cells in multiple myeloma. The lack of surface proteins that specifically mark plasma cells has hampered the development of antibodies or cellular therapies for multiple myeloma. So far, there are few cases of successful biologics, including daratumumab (anti-CD38) and elotuzumab (anti-CD319), with the caveat that both antigens are also expressed on other normal tissues including hematopoietic lineages and immune effector cells, which may limit their long-term clinical use. B cell maturation antigen (BCMA), a transmembrane glycoprotein in the tumor necrosis factor receptor superfamily 17 (TNFRSF17), is expressed at significantly higher levels in all patient MM cells but not on other normal tissues except normal plasma cells. BCMA-chimeric antigen receptor (CAR) T-cells have already shown significant clinical activities in patients with RRMM who have undergone at least three prior treatments, including a proteasome inhibitor and an immunomodulatory agent. Additional modalities, including anti-BCMA antibody-drug conjugate also has achieved significant clinical responses in patients who failed at least three prior lines of therapy, including an anti-CD38 antibody, a proteasome inhibitor, and an immunomodulatory agent (Cho et al, 2018). One challenge of e.g. BCMA- or CD38-targeted therapy lies in the presence of high levels of soluble BCMA or CD38 in the serum of MM patients, which may reduce the amount of active drug in the patient. An alternative might be new targets, such as the G protein-coupled receptor class C group 5 member D (GPRC5D), that is differentially expressed by plasma cells in multiple myeloma versus plasma cells from healthy donors, and has no soluble form. It has been reported that GPRC5D is associated with prognosis and tumor load in multiple myeloma patients (Atamaniuk, J. et al., 2012; and Cohen, Y., et al., 2013). GPRC5D is an orphan receptor with no known ligand(s) and largely unknown biology in men in general and in cancer specifically. The GPRC5D encoding gene, which is mapped on chromosome12p13.3, contains three exons and spans about 9.6 kb (Brauner-Osbome, H. et al. 2001). The large first exon encodes the seven-transmembrane domain. It has been shown that GPRC5D is involved in keratin formation in hair follicles in animals (Gao, Y. et al., 2016, and Inoue, S. et al., 2004). WO 2018/017786 A2 discloses GPRC5D-specific antibodies or antigen-binding fragments.

Rationale for Targeting CD28 Agonism to Diseased Plasma Cells in Multiple Myeloma CD28 agonism in Multiple Myeloma may exert different biological functions on immune, respective MM plasma cells. While co-activation of T-cells via CD28 is expected to drive anti-tumor responses, CD28 agonism on MM cells mediates pro-survival signaling via regulation of PI3K/Akt, FoxO3a, and Bimm which in turn is described to induce chemotherapeutic resistance in multiple myeloma (Murray M. E. et al, 2014). Over-expression of CD28 on newly diagnosed Multiple Myeloma plasma cells is described to correlate with worse clinical outcome (Bahlis et al., 2007). However, while CD28 activation enhances myeloma cell survival, its activation inhibits myeloma cell proliferation. Agonizing CD28 in presence of a strong immune cell mediated response, such as a T-cell bispecific activation of T-cells, can further boost efficient anti-tumor responses. We herein provide bispecific agonistic CD28 antigen binding molecules that specifically bind a human Multiple Myeloma (MM) cell surface antigen. Particularly, the bispecific agonistic CD28 antigen binding molecules according to the invention targeting the TAAs selected from BCMA, CD38 and GPRC5D and CD28 expressed on T-cells have the potency to treat multiple myeloma as single agent or in combination with other agents such as T cell bispecific antibodies (TCBs) targeting a human MM cell surface antigen.

SUMMARY

The present invention describes tumor-targeted bispecific agonistic CD28 antigen binding molecules which achieve a tumor-dependent T cell activation and tumor cell killing without the necessity to form multimers. The bispecific CD28 antigen binding molecules of the present invention are characterized by monovalent binding to CD28 and in that they comprise at least one antigen binding domain capable of specific binding to a tumor-associated antigen (such as Fibroblast Activation Protein (FAP) or Carcinoembryonic Antigen (CEA), CD19 or GPRC5D). Furthermore, they possess an Fc domain composed of a first and a second subunit capable of stable association comprising one or more amino acid substitution that reduces the binding affinity of the antigen binding molecule to an Fc receptor and/or effector function. Fc receptor-mediated cross-linking is thereby abrogated and tumor-specific activation is achieved by cross-linking through binding of the at least one antigen binding domain capable of specific binding to a tumor-associated antigen to its antigen.

Thus, the invention provides a bispecific agonistic CD28 antigen binding molecule characterized by monovalent binding to CD28, comprising
(a) one antigen binding domain capable of specific binding to CD28,
(b) at least one antigen binding domain capable of specific binding to a tumor-associated antigen, and
(c) an Fc domain composed of a first and a second subunit capable of stable association comprising one or more amino acid substitution that reduces the binding affinity of the antigen binding molecule to an Fc receptor and/or effector function.

In one aspect, a bispecific agonistic CD28 antigen binding molecule as defined below is provided, wherein the Fc domain is an IgG, particularly an IgG1 Fc domain or an IgG4 Fc domain. In one particular aspect, the Fc domain composed of a first and a second subunit capable of stable association is an IgG1 Fc domain. In one aspect, the Fc domain comprises the amino acid substitutions L234A and L235A (numbering according to Kabat EU index). In one aspect, the Fc domain is of human IgG1 subclass and comprises the amino acid mutations L234A, L235A and P329G (numbering according to Kabat EU index).

In one aspect, provided is a bispecific agonistic CD28 antigen binding molecule as defined herein before, wherein the antigen binding domain capable of specific binding to CD28 comprises
(i) a heavy chain variable region ($V_H$CD28) comprising a heavy chain complementary determining region CDR-H1 of SEQ ID NO: 36, a CDR-H2 of SEQ ID NO: 37, and a CDR-H3 of SEQ ID NO: 38, and a light chain variable region ($V_L$CD28) comprising a light chain complementary determining region CDR-L1 of SEQ ID NO: 39, a CDR-L2 of SEQ ID NO: 40 and a CDR-L3 of SEQ ID NO: 41; or
(ii) a heavy chain variable region ($V_H$CD28) comprising a CDR-H1 of SEQ ID NO: 20, a CDR-H2 of SEQ ID NO: 21, and a CDR-H3 of SEQ ID NO: 22, and a light chain variable region ($V_L$CD28) comprising a CDR-L1 of SEQ ID NO: 23, a CDR-L2 of SEQ ID NO: 24 and a CDR-L3 of SEQ ID NO: 25.

In one aspect, the antigen binding domain capable of specific binding to CD28 of the bispecific agonistic CD28 antigen binding molecule comprises a heavy chain variable region ($V_H$CD28) comprising a CDR-H1 of SEQ ID NO: 36, a CDR-H2 of SEQ ID NO: 37, and a CDR-H3 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

In another aspect, the antigen binding domains capable of specific binding to CD28 of the bispecific agonistic CD28 antigen binding molecule comprises a heavy chain variable region ($V_H$CD28) comprising a CDR-H1 of SEQ ID NO: 20, a CDR-H2 of SEQ ID NO: 21, and a CDR-H3 of SEQ ID NO: 22, and a light chain variable region ($V_L$CD28) comprising a CDR-L1 of SEQ ID NO: 23, a CDR-L2 of SEQ ID NO: 24 and a CDR-L3 of SEQ ID NO: 25.

Furthermore, provided is a bispecific agonistic CD28 antigen binding molecule as defined herein before, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:26, and a light chain variable region ($V_L$CD28) comprising an amino acid sequence that is at least about 95%, 96%, 97%, 98%, 99% or 100% identical to the amino acid sequence of SEQ ID NO:27.

In a further aspect, a bispecific agonistic CD28 antigen binding molecule is provided, wherein the antigen binding domain capable of specific binding to CD28 comprises a heavy chain variable region ($V_H$CD28) comprising an amino acid sequence selected from the group consisting of SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50 and SEQ ID NO:51, and a light chain variable region ($V_L$CD28) comprising an amino acid sequence selected from the group consisting of SEQ ID NO:27, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60 and SEQ ID NO:61.

In another aspect, provided is a bispecific agonistic CD28 antigen binding molecule, wherein the antigen binding domain capable of specific binding to CD28 comprises
(a) a heavy chain variable region ($V_H$CD28) comprising the amino acid sequence of SEQ ID NO:47 and a light chain variable region ($V_L$CD28) comprising the amino acid sequence of SEQ ID NO:54, or
(b) a heavy chain variable region ($V_H$CD28) comprising the amino acid sequence of SEQ ID NO:47 and a light chain variable region ($V_L$CD28) comprising the amino acid sequence of SEQ ID NO:27, or
(c) a heavy chain variable region ($V_H$CD28) comprising the amino acid sequence of SEQ ID NO:51 and a light chain variable region ($V_L$CD28) comprising the amino acid sequence of SEQ ID NO:61, or
(d) a heavy chain variable region ($V_H$CD28) comprising the amino acid sequence of SEQ ID NO:46 and a light chain variable region (V$_L$CD28) comprising the amino acid sequence of SEQ ID NO:53, or (e) a heavy chain variable region (V$_H$CD28) comprising the amino acid sequence of SEQ ID NO:46 and a light chain variable region (V$_L$CD28) comprising the amino acid sequence of SEQ ID NO:54, or (f) a heavy chain variable region (V$_H$CD28) comprising the amino acid sequence of SEQ ID NO:46 and a light chain variable region (V$_L$CD28) comprising the amino acid sequence of SEQ ID NO:59, or (g) a heavy chain variable region (V$_H$CD28) comprising the amino acid sequence of SEQ ID NO:46 and a light chain variable region (V$_L$CD28) comprising the amino acid sequence of SEQ ID NO:27, or (h) a heavy chain variable region (V$_H$CD28) comprising the amino acid sequence of SEQ ID NO:43 and a light chain variable region (V$_L$CD28) comprising the amino acid sequence of SEQ ID NO:27, or (i) a heavy chain variable region (V$_H$CD28) comprising the amino acid sequence of SEQ ID NO:42 and a light chain variable region (V$_L$CD28) comprising the amino acid sequence of SEQ ID NO:53, or (j) a heavy chain variable region (V$_H$CD28) comprising the amino acid sequence of SEQ ID NO:42 and a light chain variable region (V$_L$CD28) comprising the amino acid sequence of SEQ ID NO:59, or (k) a heavy chain variable region (V$_H$CD28) comprising the amino acid sequence of SEQ ID NO:42 and a light chain variable region (V$_L$CD28) comprising the amino acid sequence of SEQ ID NO:27.

In one particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:47 and a light chain variable region (V$_L$CD28) comprising the amino acid sequence of SEQ ID NO:54.

In another particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:46 and a light chain variable region (V$_L$CD28) comprising the amino acid sequence of SEQ ID NO:53.

In a further particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:42 and a light chain variable region (V$_L$CD28) comprising the amino acid sequence of SEQ ID NO:27.

In one aspect, a bispecific agonistic CD28 antigen binding molecule is provided, wherein the antigen binding domain capable of specific binding to a tumor-associated antigen is an antigen binding domain capable of specific binding to Carcinoembryonic Antigen (CEA).

In one aspect, provided is a bispecific agonistic CD28 antigen binding molecule as described herein, wherein the antigen binding domain capable of specific binding to CEA comprises (i) a heavy chain variable region (V$_H$CEA) comprising a CDR-H1 comprising the amino acid sequence of SEQ ID NO:188, a CDR-H2 comprising the amino acid sequence of SEQ ID NO:189, and a CDR-H3 comprising the amino acid sequence of SEQ ID NO:190, and a light chain variable region (V$_L$CEA) comprising a CDR-L1 comprising the amino acid sequence of SEQ ID NO:191, a CDR-L2 comprising the amino acid sequence of SEQ ID NO:192, and a CDR-L3 comprising the amino acid sequence of SEQ ID NO:193; or (ii) a heavy chain variable region (V$_H$CEA) comprising a CDR-H1 comprising the amino acid sequence of SEQ ID NO:180, a CDR-H2 comprising the amino acid sequence of SEQ ID NO:181, and a CDR-H3 comprising the amino acid sequence of SEQ ID NO:182, and a light chain variable region (V$_L$CEA) comprising a CDR-L1 comprising the amino acid sequence of SEQ ID NO:183, a CDR-L2 comprising the amino acid sequence of SEQ ID NO:184, and a CDR-L3 comprising the amino acid sequence of SEQ ID NO:185; or (iii) a heavy chain variable region (V$_H$CEA) comprising a CDR-H1 comprising the amino acid sequence of SEQ ID NO:127, a CDR-H2 comprising the amino acid sequence of SEQ ID NO:128, and a CDR-H3 comprising the amino acid sequence of SEQ ID NO:129, and a light chain variable region (V$_L$CEA) comprising a CDR-L1 comprising the amino acid sequence of SEQ ID NO:130, a CDR-L2 comprising the amino acid sequence of SEQ ID NO:131, and a CDR-L3 comprising the amino acid sequence of SEQ ID NO:132, or (iv) a heavy chain variable region (V$_H$CEA) comprising a CDR-H1 comprising the amino acid sequence of SEQ ID NO:507, a CDR-H2 comprising the amino acid sequence of SEQ ID NO:508, and a CDR-H3 comprising the amino acid sequence of SEQ ID NO:509, and a light chain variable region (V$_L$CEA) comprising a CDR-L1 comprising the amino acid sequence of SEQ ID NO:510, a CDR-L2 comprising the amino acid sequence of SEQ ID NO:511, and a CDR-L3 comprising the amino acid sequence of SEQ ID NO:512.

In one aspect, the antigen binding domain capable of specific binding to CEA comprises a heavy chain variable region (V$_H$CEA) comprising an amino acid sequence that is at least about 95%, 96%, 97%, 98%, 99% or 100% identical to the amino acid sequence of SEQ ID NO:133, and a light chain variable region (V$_L$CEA) comprising an amino acid sequence that is at least about 95%, 96%, 97%, 98%, 99% or 100% identical to the amino acid sequence of SEQ ID NO:134. Particularly, the antigen binding domain capable of specific binding to CEA comprises a heavy chain variable region (V$_H$CEA) comprising the amino acid sequence of SEQ ID NO:186, and a light chain variable region (V$_L$CEA) comprising the amino acid sequence of SEQ ID NO:187.

In another aspect, provided is a bispecific agonistic CD28 antigen binding molecule, wherein the antigen binding domain capable of specific binding to CEA comprises (a) a heavy chain variable region (V$_H$CEA) comprising the amino acid sequence of SEQ ID NO:194 and a light chain variable region (V$_L$CEA) comprising the amino acid sequence of SEQ ID NO:195, or (b) a heavy chain variable region (V$_H$CEA) comprising the amino acid sequence of SEQ ID NO:196 and a light chain variable region (V$_L$CEA) comprising the amino acid sequence of SEQ ID NO:197, or (c) a heavy chain variable region (V$_H$CEA) comprising the amino acid sequence of SEQ ID NO:198 and a light chain variable region (V$_L$CEA) comprising the amino acid sequence of SEQ ID NO:199, or (d) a heavy chain variable region (V$_H$CEA) comprising the amino acid sequence of SEQ ID NO:200 and a light chain variable region (V$_L$CEA) comprising the amino acid sequence of SEQ ID NO:201, or (e) a heavy chain variable region (V$_H$CEA) comprising the amino acid sequence of SEQ ID NO:202 and a light chain variable region (V$_L$CEA) comprising the amino acid sequence of SEQ ID NO:203, or (f) a heavy chain variable region (V$_H$CEA) comprising the amino acid sequence of SEQ ID NO:204 and a light chain variable region (V$_L$CEA) comprising the amino acid sequence of SEQ ID NO:205, or (g) a heavy chain variable region (V$_H$CEA) comprising the amino acid sequence of SEQ ID NO:206 and a light chain variable region (V$_L$CEA) comprising the amino acid sequence of SEQ ID NO:207, or (h) a heavy chain variable region (V$_H$CEA) comprising the amino acid sequence of SEQ ID NO:208 and a light chain variable region (V$_L$CEA) comprising the amino acid sequence of SEQ ID NO:209, or (i) a heavy chain variable region (V$_H$CEA) comprising the amino acid sequence of SEQ ID NO:210 and a light chain variable region (V$_L$CEA) comprising the amino acid sequence of SEQ ID NO:211, or (j) a heavy chain variable region (V$_H$CEA) comprising the amino acid sequence of SEQ ID NO:212 and a light chain variable region (V$_L$CEA) comprising the amino acid sequence of SEQ ID NO:213.

Particularly, the antigen binding domain capable of specific binding to CEA comprises a heavy chain variable region (V$_H$CEA) comprising the amino acid sequence of SEQ ID NO:200 and a light chain variable region (V$_L$CEA) comprising the amino acid sequence of SEQ ID NO:201.

In another aspect, a bispecific agonistic CD28 antigen binding molecule is provided, wherein the antigen binding domain capable of specific binding to a tumor-associated antigen is an antigen binding domain capable of specific binding to Fibroblast Activation Protein (FAP). In one aspect, provided is a bispecific agonistic CD28 antigen binding molecule as described herein, wherein the antigen binding domain capable of specific binding to FAP comprises (a) a heavy chain variable region (V$_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region (V$_L$FAP) comprising (iv) CDR-L1 comprising the amino acid sequence of SEQ ID NO:15, (v) CDR-L2 comprising the amino acid sequence of SEQ ID NO:16, and (vi) CDR-L3 comprising the amino acid sequence of SEQ ID NO:17, or (b) a heavy chain variable region (V$_H$FAP) comprising (i) CDR-H1 comprising the amino acid sequence of SEQ ID NO:4, (ii) CDR-H2 comprising the amino acid sequence of SEQ ID NO:5, and (iii) CDR-H3 comprising the amino acid sequence of SEQ ID NO:6, and a light chain variable region (V$_L$FAP) comprising (iv) CDR-L1 comprising the amino acid sequence of SEQ ID NO:7, (v) CDR-L2 comprising the amino acid sequence of SEQ ID NO:8, and (vi) CDR-L3 comprising the amino acid sequence of SEQ ID NO:9. In particular, the antigen binding domain capable of specific binding to FAP comprises a heavy chain variable region (V$_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region (V$_L$FAP) comprising (iv) CDR-L1 comprising the amino acid sequence of SEQ ID NO:15, (v) CDR-L2 comprising the amino acid sequence of SEQ ID NO:16, and (vi) CDR-L3 comprising the amino acid sequence of SEQ ID NO:17. In one aspect, a bispecific agonistic CD28 antigen binding molecule is provided, wherein the antigen binding domain capable of specific binding to FAP comprises (a) a heavy chain variable region (V$_H$FAP) comprising an amino acid sequence that is at least about 95%, 96%, 97%, 98%, 99% or 100% identical to the amino acid sequence of SEQ ID NO:18, and a light chain variable region (V$_L$FAP) comprising an amino acid sequence that is at least about 95%, 96%, 97%, 98%, 99% or 100% identical to the amino acid sequence of SEQ ID NO:19, or (b) a heavy chain variable region (V$_H$FAP) comprising an amino acid sequence that is at least about 95%, 96%, 97%, 98%, 99% or 100% identical to the amino acid sequence of SEQ ID NO:10, and a light chain variable region (V$_L$FAP) comprising an amino acid sequence that is at least about 95%, 96%, 97%, 98%, 99% or 100% identical to the amino acid sequence of SEQ ID NO:11. Particularly, the antigen binding domain capable of specific binding to FAP comprises a heavy chain variable region (V$_H$FAP) comprising the amino acid sequence of SEQ ID NO:18 and a light chain variable region (V$_L$FAP) comprising the amino acid sequence of SEQ ID NO:19.

In another aspect, a bispecific agonistic CD28 antigen binding molecule is provided, wherein the antigen binding domain capable of specific binding to a tumor-associated antigen is an antigen binding domain capable of specific binding to epithelial cell adhesion molecule (EpCAM). In one aspect, provided is a bispecific agonistic CD28 antigen binding molecule as described herein, wherein the antigen binding domain capable of specific binding to EpCAM comprises a heavy chain variable region (V$_H$EpCAM) comprising (i) CDR-H1 comprising the amino acid sequence of SEQ ID NO:515, (ii) CDR-H2 comprising the amino acid sequence of SEQ ID NO:516, and (iii) CDR-H3 comprising the amino acid sequence of SEQ ID NO:517, and a light chain variable region (V$_L$EpCAM) comprising (iv) CDR-L1 comprising the amino acid sequence of SEQ ID NO:518, (v) CDR-L2 comprising the amino acid sequence of SEQ ID NO:519, and (vi) CDR-L3 comprising the amino acid sequence of SEQ ID NO:520. In one aspect, a bispecific agonistic CD28 antigen binding molecule is provided, wherein the antigen binding domain capable of specific binding to EpCAM comprises (a) a heavy chain variable region (V$_H$EpCAM) comprising an amino acid sequence that is at least about 95%, 96%, 97%, 98%, 99% or 100% identical to the amino acid sequence of SEQ ID NO:521, and a light chain variable region (V$_L$EpCAM) comprising an amino acid sequence that is at least about 95%, 96%, 97%, 98%, 99% or 100% identical to the amino acid sequence of SEQ ID NO:522. Particularly, the antigen binding domain capable of specific binding to EpCAM comprises a heavy chain variable region (V$_H$EpCAM) comprising the amino acid sequence of SEQ ID NO:521 and a light chain variable region (V$_L$EpCAM) comprising the amino acid sequence of SEQ ID NO:522.

In another aspect, a bispecific agonistic CD28 antigen binding molecule is provided, wherein the antigen binding domain capable of specific binding to a tumor-associated antigen is an antigen binding domain capable of specific binding to HER3. In one aspect, provided is a bispecific agonistic CD28 antigen binding molecule as described herein, wherein the antigen binding domain capable of specific binding to HER3 comprises a heavy chain variable region (V$_H$HER3) comprising (i) CDR-H1 comprising the amino acid sequence of SEQ ID NO:523, (ii) CDR-H2 comprising the amino acid sequence of SEQ ID NO:524, and (iii) CDR-H3 comprising the amino acid sequence of SEQ ID NO:525, and a light chain variable region (V$_L$HER3) comprising (iv) CDR-L1 comprising the amino acid sequence of SEQ ID NO:526, (v) CDR-L2 comprising the amino acid sequence of SEQ ID NO:527, and (vi) CDR-L3 comprising the amino acid sequence of SEQ ID NO:528. In one aspect, a bispecific agonistic CD28 antigen binding molecule is provided, wherein the antigen binding domain capable of specific binding to HER3 comprises (a) a heavy chain variable region ($V_H$HER3) comprising an amino acid sequence that is at least about 95%, 96%, 97%, 98%, 99% or 100% identical to the amino acid sequence of SEQ ID NO:529, and a light chain variable region ($V_L$HER3) comprising an amino acid sequence that is at least about 95%, 96%, 97%, 98%, 99% or 100% identical to the amino acid sequence of SEQ ID NO:530. Particularly, the antigen binding domain capable of specific binding to HER3 comprises a heavy chain variable region ($V_H$HER3) comprising the amino acid sequence of SEQ ID NO:529 and a light chain variable region ($V_L$HER3) comprising the amino acid sequence of SEQ ID NO:530.

In yet another aspect, a bispecific agonistic CD28 antigen binding molecule is provided, wherein the antigen binding domain capable of specific binding to a tumor-associated antigen is an antigen binding domain capable of specific binding to CD30. In one aspect, provided is a bispecific agonistic CD28 antigen binding molecule as described herein, wherein the antigen binding domain capable of specific binding to CD30 comprises a heavy chain variable region ($V_H$CD30) comprising (i) CDR-H1 comprising the amino acid sequence of SEQ ID NO:531, (ii) CDR-H2 comprising the amino acid sequence of SEQ ID NO:532, and (iii) CDR-H3 comprising the amino acid sequence of SEQ ID NO:533, and a light chain variable region ($V_L$CD30) comprising (iv) CDR-L1 comprising the amino acid sequence of SEQ ID NO:534, (v) CDR-L2 comprising the amino acid sequence of SEQ ID NO:535, and (vi) CDR-L3 comprising the amino acid sequence of SEQ ID NO:536. In one aspect, a bispecific agonistic CD28 antigen binding molecule is provided, wherein the antigen binding domain capable of specific binding to CD30 comprises (a) a heavy chain variable region ($V_H$CD30) comprising an amino acid sequence that is at least about 95%, 96%, 97%, 98%, 99% or 100% identical to the amino acid sequence of SEQ ID NO:537, and a light chain variable region ($V_L$CD30) comprising an amino acid sequence that is at least about 95%, 96%, 97%, 98%, 99% or 100% identical to the amino acid sequence of SEQ ID NO:538. Particularly, the antigen binding domain capable of specific binding to CD30 comprises a heavy chain variable region ($V_H$CD30) comprising the amino acid sequence of SEQ ID NO:537 and a light chain variable region ($V_L$CD30) comprising the amino acid sequence of SEQ ID NO:538.

Furthermore, provided is a bispecific agonistic CD28 antigen binding molecule, wherein the antigen binding domain capable of specific binding to a tumor-associated antigen is an antigen binding domain capable of specific binding to TBPG. In one aspect, provided is a bispecific agonistic CD28 antigen binding molecule as described herein, wherein the antigen binding domain capable of specific binding to TBPG comprises a heavy chain variable region ($V_H$TBPG) comprising (i) CDR-H1 comprising the amino acid sequence of SEQ ID NO:539, (ii) CDR-H2 comprising the amino acid sequence of SEQ ID NO:540, and (iii) CDR-H3 comprising the amino acid sequence of SEQ ID NO:541, and a light chain variable region ($V_L$TBPG) comprising (iv) CDR-L1 comprising the amino acid sequence of SEQ ID NO:542, (v) CDR-L2 comprising the amino acid sequence of SEQ ID NO:543, and (vi) CDR-L3 comprising the amino acid sequence of SEQ ID NO:544. In one aspect, a bispecific agonistic CD28 antigen binding molecule is provided, wherein the antigen binding domain capable of specific binding to TBPG comprises (a) a heavy chain variable region ($V_H$TBPG) comprising an amino acid sequence that is at least about 95%, 96%, 97%, 98%, 99% or 100% identical to the amino acid sequence of SEQ ID NO:545, and a light chain variable region ($V_L$TBPG) comprising an amino acid sequence that is at least about 95%, 96%, 97%, 98%, 99% or 100% identical to the amino acid sequence of SEQ ID NO:546. Particularly, the antigen binding domain capable of specific binding to TBPG comprises heavy chain variable region ($V_H$TBPG) comprising the amino acid sequence of SEQ ID NO:545 and a light chain variable region ($V_L$TBPG) comprising the amino acid sequence of SEQ ID NO:546.

In a further aspect, the invention provides a bispecific agonistic CD28 antigen binding molecule characterized by monovalent binding to CD28, comprising (a) one antigen binding domain capable of specific binding to CD28, (b) at least one antigen binding domain capable of specific binding to a Multiple Myeloma (MM) cell surface antigen, and (c) an Fc domain composed of a first and a second subunit capable of stable association comprising one or more amino acid substitution that reduces the binding affinity of the antigen binding molecule to an Fc receptor and/or effector function. In one aspect, the Multiple Myeloma (MM) cell surface antigen selected from the group consisting of CD38, BCMA and GPRC5D.

Thus, provided is a bispecific agonistic CD28 antigen binding molecule, wherein the antigen binding domain capable of specific binding to a tumor-associated antigen is an antigen binding domain capable of specific binding to GPRC5D. In one aspect, provided is a bispecific agonistic CD28 antigen binding molecule as described herein, wherein the antigen binding domain capable of specific binding to GPRC5D comprises (a) a heavy chain variable region ($V_H$GPRC5D) comprising (i) CDR-H1 comprising the amino acid sequence of SEQ ID NO:563, (ii) CDR-H2 comprising the amino acid sequence of SEQ ID NO:564, and (iii) CDR-H3 comprising the amino acid sequence of SEQ ID NO:565, and a light chain variable region ($V_L$GPRC5D) comprising (iv) CDR-L1 comprising the amino acid sequence of SEQ ID NO:566, (v) CDR-L2 comprising the amino acid sequence of SEQ ID NO:567, and (vi) CDR-L3 comprising the amino acid sequence of SEQ ID NO:568, or (b) a heavy chain variable region ($V_H$GPRC5D) comprising (i) CDR-H1 comprising the amino acid sequence of SEQ ID NO:579, (ii) CDR-H2 comprising the amino acid sequence of SEQ ID NO:580, and (iii) CDR-H3 comprising the amino acid sequence of SEQ ID NO:581, and a light chain variable region ($V_L$GPRC5D) comprising (iv) CDR-L1 comprising the amino acid sequence of SEQ ID NO:582, (v) CDR-L2 comprising the amino acid sequence of SEQ ID NO:583, and (vi) CDR-L3 comprising the amino acid sequence of SEQ ID NO:584. In one aspect, a bispecific agonistic CD28 antigen binding molecule is provided, wherein the antigen binding domain capable of specific binding to GPRC5D comprises a heavy chain variable region ($V_H$GPRC5D) comprising an amino acid sequence that is at least about 95%, 96%, 97%, 98%, 99% or 100% identical to the amino acid sequence of SEQ ID NO:569, and a light chain variable region ($V_L$GPRC5D) comprising an amino acid sequence that is at least about 95%, 96%, 97%, 98%, 99% or 100% identical to the amino acid sequence of SEQ ID NO:570. Particularly, the antigen binding domain capable of specific binding to GPRC5D comprises a heavy chain variable region ($V_H$GPRC5D) comprising the amino acid sequence of SEQ ID NO:569 and a light chain variable region (V$_L$GPRC5D) comprising the amino acid sequence of SEQ ID NO:570.

In one aspect, provided is a bispecific agonistic CD28 antigen binding molecule, wherein the antigen binding domain capable of specific binding to a tumor-associated antigen is an antigen binding domain capable of specific binding to CD38. In one aspect, provided is a bispecific agonistic CD28 antigen binding molecule as described herein, wherein the antigen binding domain capable of specific binding to CD38 comprises a heavy chain variable region (V$_H$CD38) comprising (i) CDR-H1 comprising the amino acid sequence of SEQ ID NO:547, (ii) CDR-H2 comprising the amino acid sequence of SEQ ID NO:548, and (iii) CDR-H3 comprising the amino acid sequence of SEQ ID NO:549, and a light chain variable region (V$_L$CD38) comprising (iv) CDR-L1 comprising the amino acid sequence of SEQ ID NO:550, (v) CDR-L2 comprising the amino acid sequence of SEQ ID NO:551, and (vi) CDR-L3 comprising the amino acid sequence of SEQ ID NO:552. In one aspect, a bispecific agonistic CD28 antigen binding molecule is provided, wherein the antigen binding domain capable of specific binding to CD38 comprises a heavy chain variable region (V$_H$CD38) comprising an amino acid sequence that is at least about 95%, 96%, 97%, 98%, 99% or 100% identical to the amino acid sequence of SEQ ID NO:553, and a light chain variable region (V$_L$CD38) comprising an amino acid sequence that is at least about 95%, 96%, 97%, 98%, 99% or 100% identical to the amino acid sequence of SEQ ID NO:554. Particularly, the antigen binding domain capable of specific binding to CD38 comprises a heavy chain variable region (V$_H$CD38) comprising the amino acid sequence of SEQ ID NO:553 and a light chain variable region (V$_L$CD38) comprising the amino acid sequence of SEQ ID NO:554.

In one aspect, provided is a bispecific agonistic CD28 antigen binding molecule, wherein the antigen binding domain capable of specific binding to a tumor-associated antigen is an antigen binding domain capable of specific binding to BCMA. In one aspect, provided is a bispecific agonistic CD28 antigen binding molecule as described herein, wherein the antigen binding domain capable of specific binding to BCMA comprises a heavy chain variable region (V$_H$BCMA) comprising (i) CDR-H1 comprising the amino acid sequence of SEQ ID NO:555, (ii) CDR-H2 comprising the amino acid sequence of SEQ ID NO:556, and (iii) CDR-H3 comprising the amino acid sequence of SEQ ID NO:557, and a light chain variable region (V$_L$BCMA) comprising (iv) CDR-L1 comprising the amino acid sequence of SEQ ID NO:558, (v) CDR-L2 comprising the amino acid sequence of SEQ ID NO:559, and (vi) CDR-L3 comprising the amino acid sequence of SEQ ID NO:560. In one aspect, a bispecific agonistic CD28 antigen binding molecule is provided, wherein the antigen binding domain capable of specific binding to BCMA comprises a heavy chain variable region (V$_H$BCMA) comprising an amino acid sequence that is at least about 95%, 96%, 97%, 98%, 99% or 100% identical to the amino acid sequence of SEQ ID NO:559, and a light chain variable region (V$_L$BCMA) comprising an amino acid sequence that is at least about 95%, 96%, 97%, 98%, 99% or 100% identical to the amino acid sequence of SEQ ID NO:560. Particularly, the antigen binding domain capable of specific binding to BCMA comprises a heavy chain variable region (V$_H$BCMA) comprising the amino acid sequence of SEQ ID NO:561 and a light chain variable region (V$_L$BCMA) comprising the amino acid sequence of SEQ ID NO:562.

In a further aspect, the invention provides a bispecific agonistic CD28 antigen binding molecule characterized by monovalent binding to CD28, comprising (a) one antigen binding domain capable of specific binding to CD28, (b) at least one antigen binding domain capable of specific binding to a B cell surface antigen, and (c) an Fc domain composed of a first and a second subunit capable of stable association comprising one or more amino acid substitution that reduces the binding affinity of the antigen binding molecule to an Fc receptor and/or effector function. In one aspect, the B cell surface antigen selected from the group consisting of CD19, CD79b, CD20, CD22 and CD37.

Thus, provided is a bispecific agonistic CD28 antigen binding molecule, wherein the antigen binding domain capable of specific binding to a tumor-associated antigen is an antigen binding domain capable of specific binding to CD19. In one aspect, provided is a bispecific agonistic CD28 antigen binding molecule as described herein, wherein the antigen binding domain capable of specific binding to CD19 comprises (a) a heavy chain variable region (V$_H$CD19) comprising (i) CDR-HI comprising the amino acid sequence of SEQ ID NO:406, (ii) CDR-H2 comprising the amino acid sequence of SEQ ID NO:407, and (iii) CDR-H3 comprising the amino acid sequence of SEQ ID NO:408, and a light chain variable region (V$_L$CD19) comprising (iv) CDR-L1 comprising the amino acid sequence of SEQ ID NO:409, (v) CDR-L2 comprising the amino acid sequence of SEQ ID NO:410, and (vi) CDR-L3 comprising the amino acid sequence of SEQ ID NO:411, or (b) a heavy chain variable region (V$_H$CD19) comprising (i) CDR-H1 comprising the amino acid sequence of SEQ ID NO:414, (ii) CDR-H2 comprising the amino acid sequence of SEQ ID NO:415, and (iii) CDR-H3 comprising the amino acid sequence of SEQ ID NO:416, and a light chain variable region (V$_L$CD19) comprising (iv) CDR-L1 comprising the amino acid sequence of SEQ ID NO:417, (v) CDR-L2 comprising the amino acid sequence of SEQ ID NO:418, and (vi) CDR-L3 comprising the amino acid sequence of SEQ ID NO:419. In one aspect, a bispecific agonistic CD28 antigen binding molecule is provided, wherein the antigen binding domain capable of specific binding to CD19 comprises (a) a heavy chain variable region (V$_H$CD19) comprising an amino acid sequence that is at least about 95%, 98% or 100% identical to the amino acid sequence of SEQ ID NO:412, and a light chain variable region (V$_L$CD19) comprising an amino acid sequence that is at least about 95%, 98% or 100% identical to the amino acid sequence of SEQ ID NO:413, or (b) a heavy chain variable region (V$_H$CD19) comprising an amino acid sequence that is at least about 95%, 98% or 100% identical to the amino acid sequence of SEQ ID NO:420, and a light chain variable region (V$_L$CD19) comprising an amino acid sequence that is at least about 95%, 98% or 100% identical to the amino acid sequence of SEQ ID NO:421. Particularly, the antigen binding domain capable of specific binding to CD19 comprises a heavy chain variable region (V$_H$CD19) comprising an amino acid sequence of SEQ ID NO:412 and a light chain variable region (V$_L$CD19) comprising an amino acid sequence of SEQ ID NO:413.

In one aspect, provided is a bispecific agonistic CD28 antigen binding molecule, wherein the antigen binding domain capable of specific binding to a tumor-associated antigen is an antigen binding domain capable of specific binding to CD79b. In one aspect, provided is a bispecific agonistic CD28 antigen binding molecule as described herein, wherein the antigen binding domain capable of specific binding to CD79b comprises a heavy chain variable region (V$_H$CD79b) comprising (i) CDR-H1 comprising the amino acid sequence of SEQ ID NO:422, (ii) CDR-H2 comprising the amino acid sequence of SEQ ID NO:423, and (iii) CDR-H3 comprising the amino acid sequence of SEQ ID NO:424, and a light chain variable region (V$_L$CD79b) comprising (iv) CDR-L1 comprising the amino acid sequence of SEQ ID NO:425, (v) CDR-L2 comprising the amino acid sequence of SEQ ID NO:426, and (vi) CDR-L3 comprising the amino acid sequence of SEQ ID NO:427. In one aspect, a bispecific agonistic CD28 antigen binding molecule is provided, wherein the antigen binding domain capable of specific binding to CD79b comprises a heavy chain variable region (V$_H$CD79b) comprising an amino acid sequence that is at least about 95%, 96%, 97%, 98%, 99% or 100% identical to the amino acid sequence of SEQ ID NO:428, and a light chain variable region (V$_L$CD79b) comprising an amino acid sequence that is at least about 95%, 96%, 97%, 98%, 99% or 100% identical to the amino acid sequence of SEQ ID NO:429. Particularly, the antigen binding domain capable of specific binding to CD79b comprises a heavy chain variable region (V$_H$CD79b) comprising the amino acid sequence of SEQ ID NO:428, and a light chain variable region (V$_L$CD79b) comprising the amino acid sequence of SEQ ID NO:429.

In a further aspect, provided is a bispecific agonistic CD28 antigen binding molecule as defined herein before, wherein the antigen binding domain capable of specific binding to CD28 is a Fab fragment or a crossFab fragment.

In another aspect, provided is a bispecific agonistic CD28 antigen binding molecule as described herein, comprising
(a) one Fab fragment capable of specific binding to CD28,
(b) one crossFab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

In a further aspect, provided is a bispecific agonistic CD28 antigen binding molecule as described herein, comprising
(a) a first Fab fragment capable of specific binding to CD28,
(b) a second Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of one of the Fc domain subunits.

In another aspect, a bispecific agonistic CD28 antigen binding molecule as disclosed herein is provided, comprising
(a) a first Fab fragment capable of specific binding to CD28,
(b) a second and a third Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

In a further aspect, provided is a bispecific agonistic CD28 antigen binding molecule as described herein, comprising
(a) a Fab fragment capable of specific binding to CD28,
(b) a VH and VL domain capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function, wherein the Fab fragment capable of specific binding to CD28 is fused at its C-terminus to the N-terminus of the first Fc domain subunit, and wherein one of the VH and VL domain capable of specific binding to a tumor-associated antigen is fused via a peptide linker to the C-terminus of the first Fc domain subunit and the other one of the VH and VL domain capable of specific binding to a tumor-associated antigen is fused via a peptide linker to the C-terminus of the second Fc domain subunit.

According to another aspect of the invention, there is provided one or more isolated polynucleotide(s) encoding the bispecific agonistic CD28 antigen binding molecule of the invention. The invention further provides one or more vector(s), particularly expression vector(s), comprising the isolated polynucleotide(s) of the invention, and a host cell comprising the isolated polynucleotide(s) or the expression vector(s) of the invention. In some aspects, the host cell is a eukaryotic cell, particularly a mammalian cell. In another aspect, provided is a method of producing a bispecific agonistic CD28 antigen binding molecule as described herein comprising culturing the host cell of the invention under conditions suitable for the expression of the bispecific agonistic CD28 antigen binding molecule. Optionally, the method also comprises recovering the bispecific agonistic CD28 antigen binding molecule. The invention also encompasses a bispecific agonistic CD28 antigen binding molecule produced by the method of the invention.

The invention further provides a pharmaceutical composition comprising a bispecific agonistic CD28 antigen binding molecule of the invention and at least one pharmaceutically acceptable excipient. In one aspect, the pharmaceutical composition is for use in the treatment of cancer.

Also encompassed by the invention are methods of using the bispecific agonistic CD28 antigen binding molecule and the pharmaceutical composition of the invention. In one aspect the invention provides a bispecific agonistic CD28 antigen binding molecule or a pharmaceutical composition according to the invention for use as a medicament. In one aspect, provided is a bispecific agonistic CD28 antigen binding molecule as described herein for use in (a) enhancing cell activation or (b) enhancing T cell effector functions. In one aspect, provided is a bispecific agonistic CD28 antigen binding molecule or a pharmaceutical composition according to the invention for use in the treatment of a disease. In a specific aspect, the disease is cancer. In another aspect is provided a bispecific agonistic CD28 antigen binding molecule or pharmaceutical composition according to the invention is for use in the treatment of cancer, wherein the bispecific agonistic CD28 antigen binding molecule is administered in combination with a chemotherapeutic agent, radiation therapy and/or other agents for use in cancer immunotherapy. In a further aspect, provided is a bispecific agonistic CD28 antigen binding molecule or a pharmaceutical composition for use in the treatment of cancer, wherein the bispecific agonistic CD28 antigen binding molecule is administered in combination with a T-cell activating anti-CD3 bispecific antibody. In yet another aspect, provided is a bispecific agonistic CD28 antigen binding molecule or a pharmaceutical composition for use in the treatment of cancer, wherein the bispecific agonistic CD28 antigen binding molecule is administered in combination with an anti-PD-L1 antibody or an anti-PD-1 antibody.

Also provided is the use of a bispecific agonistic CD28 antigen binding molecule according to the invention in the manufacture of a medicament for the treatment of a disease; as well as a method of treating a disease in an individual, comprising administering to said individual a therapeutically effective amount of a bispecific agonistic CD28 antigen binding molecule according to the invention or a composition comprising the bispecific agonistic CD28 antigen binding molecule according to the invention in a pharmaceutically acceptable form. In a specific aspect, the disease is cancer. In one aspect, provided is a method (a) enhancing cell activation or (b) enhancing T cell effector functions in an individual, comprising administering a bispecific agonistic CD28 antigen binding molecule according to the invention or a composition comprising the bispecific agonistic CD28 antigen binding molecule according to the invention in a pharmaceutically acceptable form to said individual. In another aspect, provided is the use of a bispecific agonistic CD28 antigen binding molecule according to the invention in the manufacture of a medicament for the treatment of a disease, wherein the treatment comprises co-administration with a chemotherapeutic agent, radiation therapy and/or other agents for use in cancer immunotherapy. In a further aspect, provided is a method of treating a disease in an individual, comprising administering to said individual a therapeutically effective amount of a bispecific agonistic CD28 antigen binding molecule according to the invention or a composition comprising the bispecific agonistic CD28 antigen binding molecule according to the invention in a pharmaceutically acceptable form, wherein the method comprises co-administration with a chemotherapeutic agent, radiation therapy and/or other agents for use in cancer immunotherapy. In a further aspect, provided is a method of treating a disease in an individual, comprising administering to said individual a therapeutically effective amount of a bispecific agonistic CD28 antigen binding molecule according to the invention or a composition comprising the bispecific agonistic CD28 antigen binding molecule according to the invention in a pharmaceutically acceptable form, wherein the method comprises co-administration of a T-cell activating anti-CD3 bispecific antibody. In another aspect, provided is a method of treating a disease in an individual, comprising administering to said individual a therapeutically effective amount of a bispecific agonistic CD28 antigen binding molecule according to the invention or a composition comprising the bispecific agonistic CD28 antigen binding molecule according to the invention in a pharmaceutically acceptable form, wherein the method comprises co-administration of an anti-PD-L1 antibody or an anti-PD-1 antibody. Also provided is a method of inhibiting the growth of tumor cells in an individual comprising administering to the individual an effective amount of the bispecific agonistic CD28 antigen binding molecule according to the invention, or a composition comprising the bispecific agonistic CD28 antigen binding molecule according to the invention in a pharmaceutically acceptable form, to inhibit the growth of the tumor cells. In any of the above aspects, the individual preferably is a mammal, particularly a human.

BRIEF DESCRIPTION OF THE DRAWINGS

FIG. 1A shows the CD28 agonistic antibody CD28(SA) in its huIgG4 isoform (TGN1412). FIG. 1B illustrates the CD28(SA) agonistic antibody as huIgG1 PGLALA isotype ("Fc silent").

Bispecific FAP-CD28 antigen binding molecules in 1+1 format, 1+2 format, 2+2 format and 1+4 format are shown in FIGS. 1C, 1D, 1E and 1F, respectively.

Figure 1A:
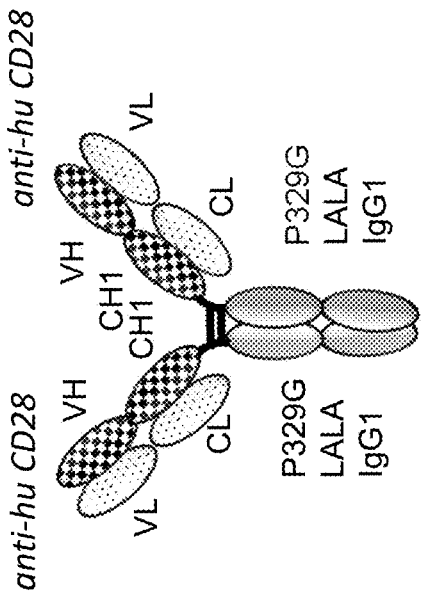
In FIGS. 1A to 1L schematic illustrations of the molecules as described are shown.
Figure 1C:
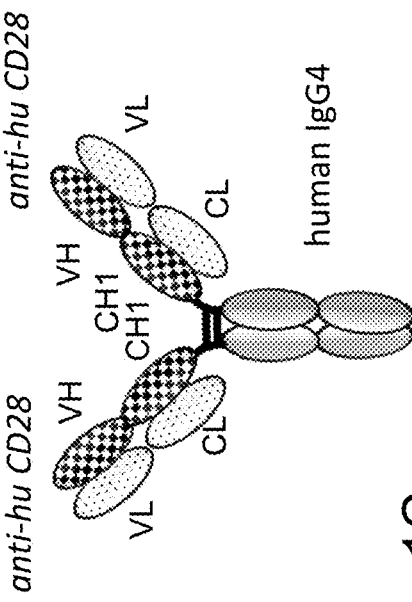
Figure 1B:
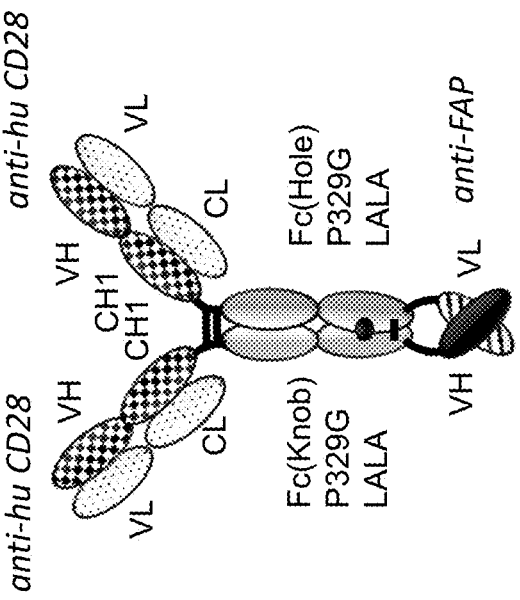
Figure 1D:
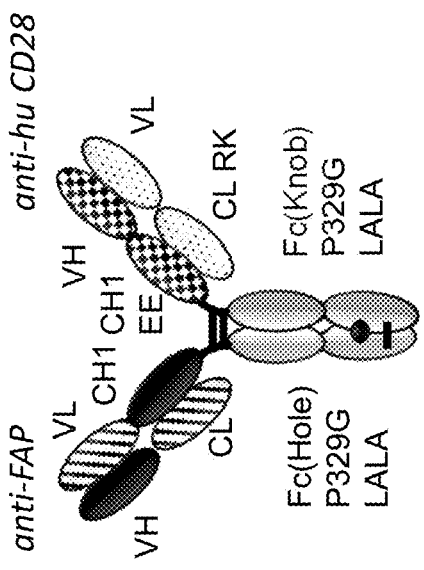
Figure 1H:
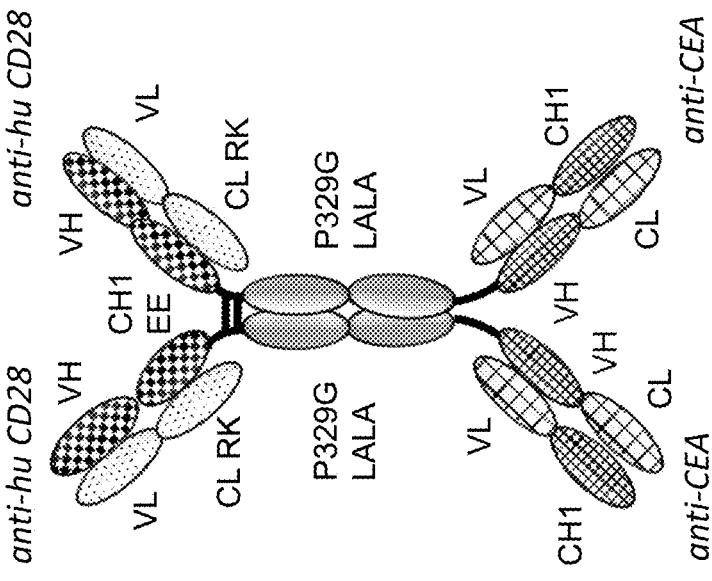
Figure 1G:
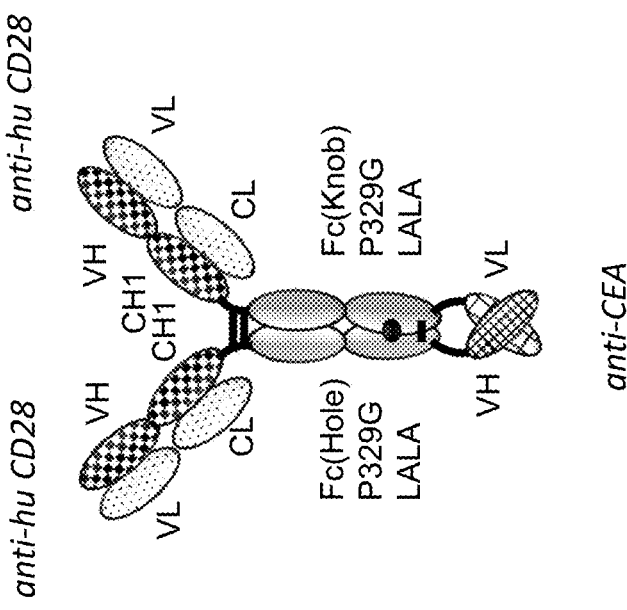
Figure 1J:
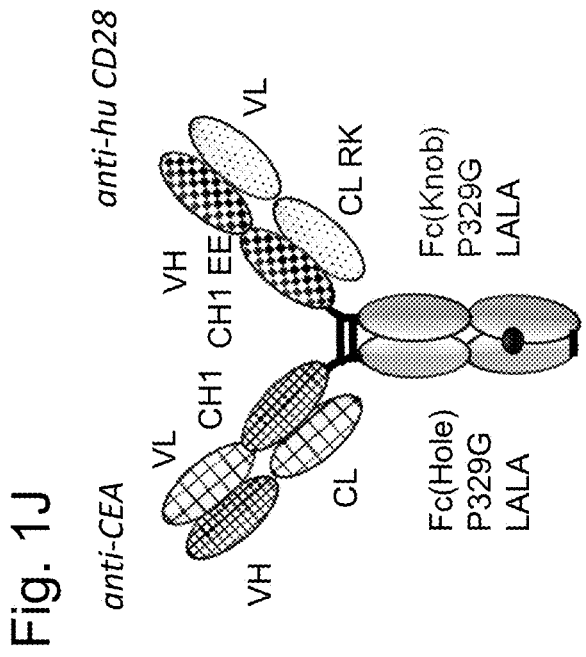

Bispecific CEA-CD28 antigen binding molecules in 1+2 format, 2+2 format and 1+1 format are shown in FIGS. 1G, 1H and 1J, respectively.

Figure 1I:
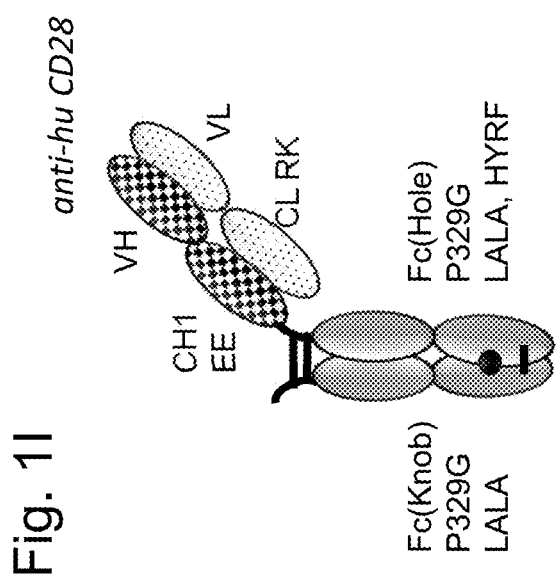

FIG. 1I shows a schematic illustration of the CD28 agonistic antibody variants as monovalent huIgG1 PGLALA isotype ("Fc silent").

Figure 1K:
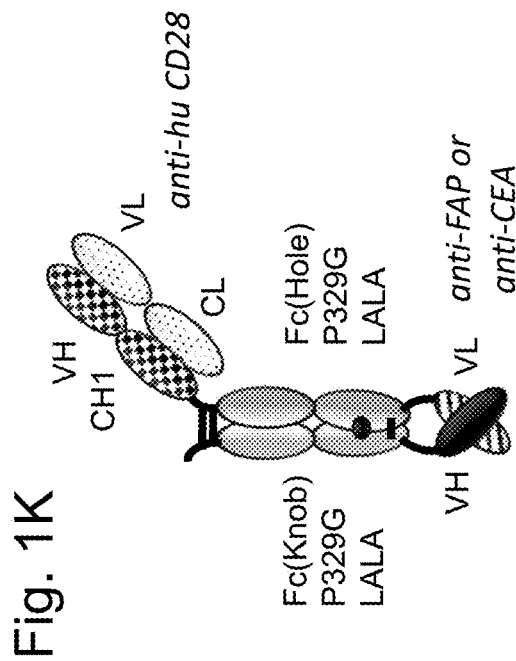

FIG. 1K shows a bispecific FAP-CD28 antigen binding molecule in 1+1 format, wherein the FAP antigen binding domain is represented as VH and VL domains each fused to one C-terminus of the Fc domain subunits.

Figure 1M:
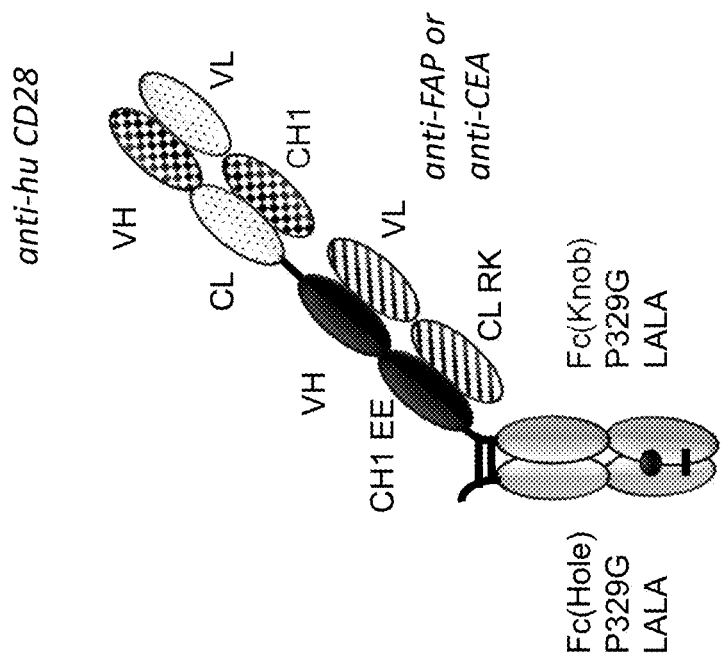
Figure 1L:
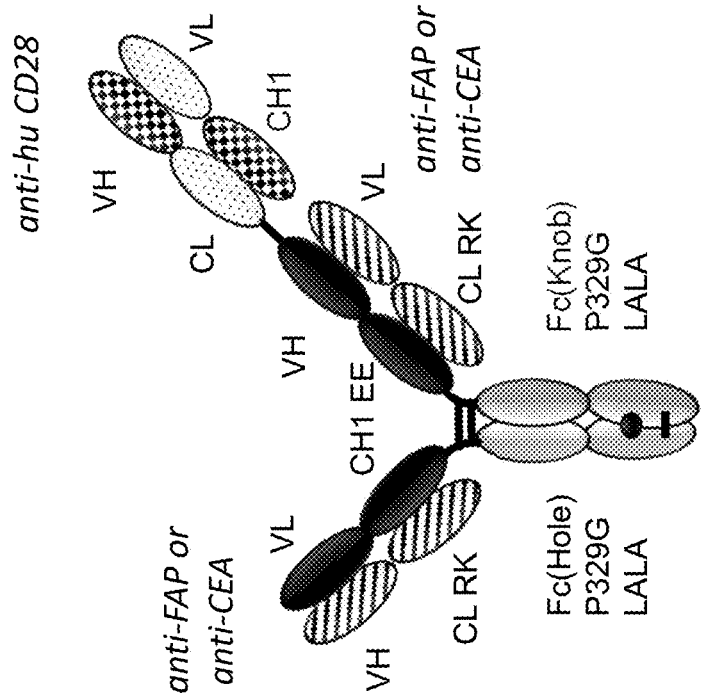

FIG. 1L illustrates a bispecific FAP-CD28 antigen binding molecule in 2+1 format, wherein the CD28 antigen binding domain is represented as crossFab that is fused at its C-terminus to the N-terminus of one of the heavy chains of the "bivalent" FAP antibody.

FIG. 1M shows another bispecific FAP-CD28 antigen binding molecule in 1+1 format, wherein the CD28 antigen binding domain is represented as crossFab that is fused at its C-terminus to the N-terminus of the Fab fragment binding to FAP.

Figure 1N:
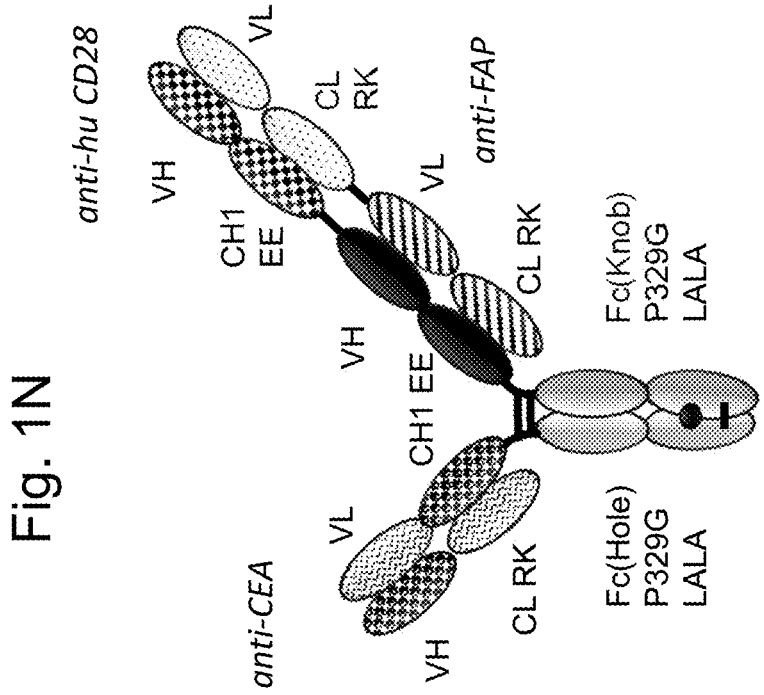

FIG. 1N illustrates a trispecific FAP-CEA-CD28 antigen binding molecule in 1+1+1 format, wherein the CD28 antigen binding domain is represented as Fab that is fused at the C-terminus of both the light and the heavy chain to the N-terminus of both the light and heavy chain of the anti-FAP antigen binding domain on the huIgG1 PG-LALA Fc knob chain and wherein the anti-CEA CrossFab fragment is part of the huIgG1 PG-LALA Fc hole chain.

FIGS. 2A, 2B, 2C, 2D and 2E relate to the binding of CD28 agonistic antibodies and FAP-CD28 antigen binding molecules to human CD28 or human FAP on cells. Shown is the binding of CD28(SA) in it IgG4 isoform vs. huIgG1 PGLALA isotype ti human CD28 in FIG. 2A and the binding of different FAP-CD28 molecules to human CD28 (FIG. 2B) and human FAP (FIG. 2C) on cells. Median fluorescence intensities of binding of different CD28 agonistic antibodies or anti-DP47 targeted molecules to CHO cells expressing human CD28 (parental cell line CHO-kl ATCC #CCL-61, modified to stably overexpress human CD28) or 3T3 cells expressing human FAP (NIH/3T3 cell line (ATCC CRL-1658)) was assessed by flow cytometry. Depicted are technical triplicates with SEM. A comparison of FAP(4B9)-CD28(SA) antigen binding molecules (Molecules D, E and F as described in Example 1) is shown in FIG. 2D (binding to human CD28) and FIG. 2E (binding to human FAP).

Figure 2H:
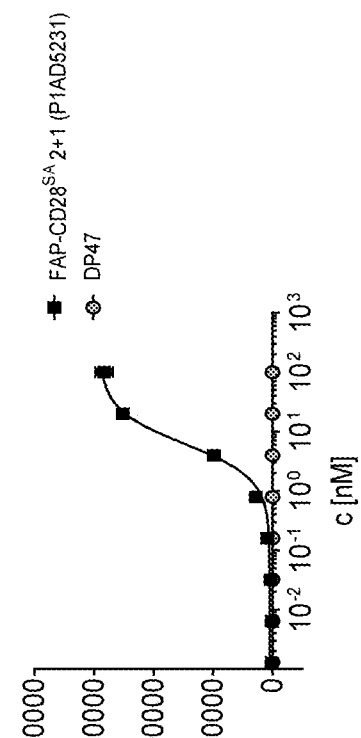
Figure 2I:
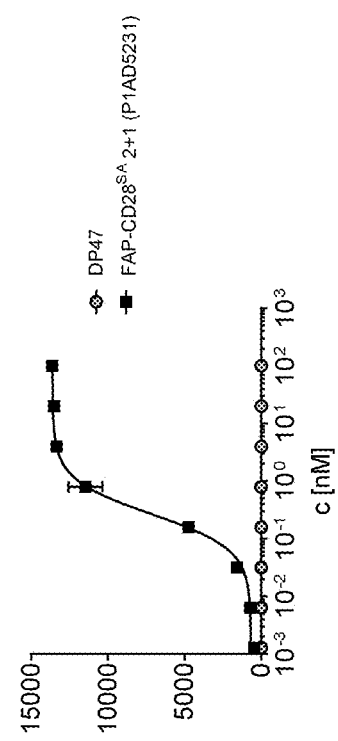
Figure 2F:
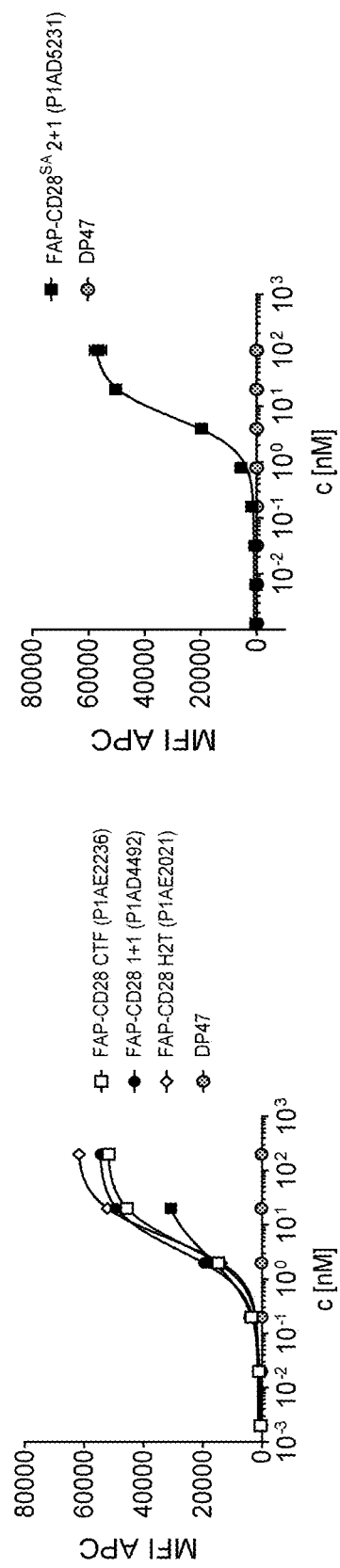
Figure 2G:
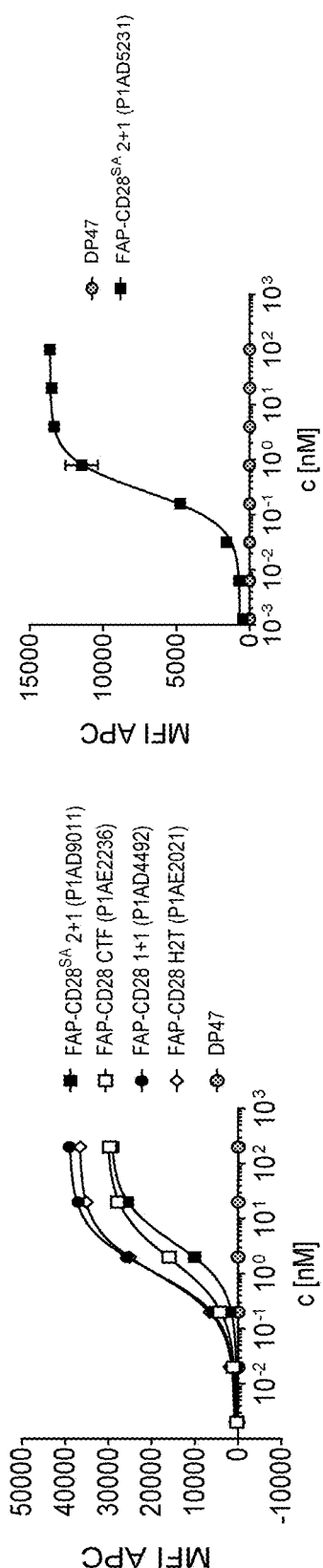

FIGS. 2F and 2G show the binding of different formats of FAP-CD28 antigen binding molecules with monovalent binding to CD28 and FAP, respectively. Shown are the curves for FAP-CD28 CTF 1+1 (P1AE2236, Molecule I), FAP-CD28 1+1 (P1AD4492, Molecule C), FAP-CD28 H2T 1+1 (P1AE2021, Molecule H), and the two compounds FAP-CD28(SA) 1+2 (P1AD9011, Molecule E) and DP47 as reference. Shown are median fluorescence intensities of binding of the FAP-CD28 antibodies or anti-DP47 antibody (negative control) to CHO cells expressing human CD28 (parental cell line CHO-kl ATCC #CCL-61, modified to stably overexpress human CD28) (FIG. 2F) or 3T3 cells expressing human FAP (NIH/3T3 cell line (ATCC CRL-1658)) (FIG. 2G), assessed by flow cytometry. Shown are technical triplicates with SEM. FIGS. 2H and 2I show the binding of FAP-CD28 2+1 (P1AE5231, Molecule G) to CD28 and FAP, respectively.

The alignment of the variable domains of CD28(SA) and variants thereof is shown in FIGS. 3A to 3D. Alignment of the CD28(SA) VH domain and variants thereof in order to remove cysteine 50 and to reduce the affinity of the resulting anti-CD28 binders to different degrees is shown in FIGS. 3A and 3B. Of note, in VH variants i and j, the CDRs of CD28(SA) were grafted from an IGHV1-2 framework into an IGHV3-23 framework (FIG. 3B). In FIGS. 3C and 3D, alignment of the CD28(SA) VL domain and variants thereof in order to reduce the affinity of the resulting anti-CD28 binders to different degrees is shown. In variant t, the CDRs were grafted into the framework sequence of the trastuzumab (Herceptin) VL sequence.

Figure 4B:
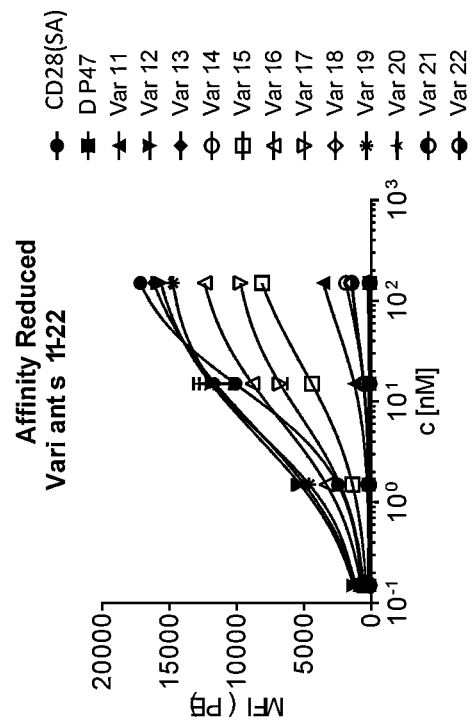
Figure 4A:
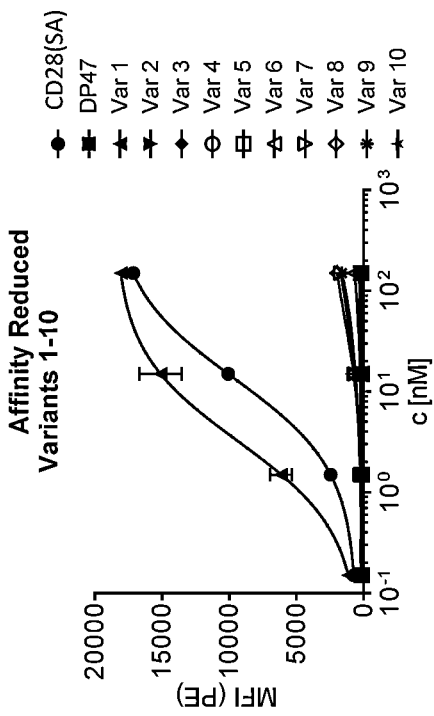
Figure 4C:
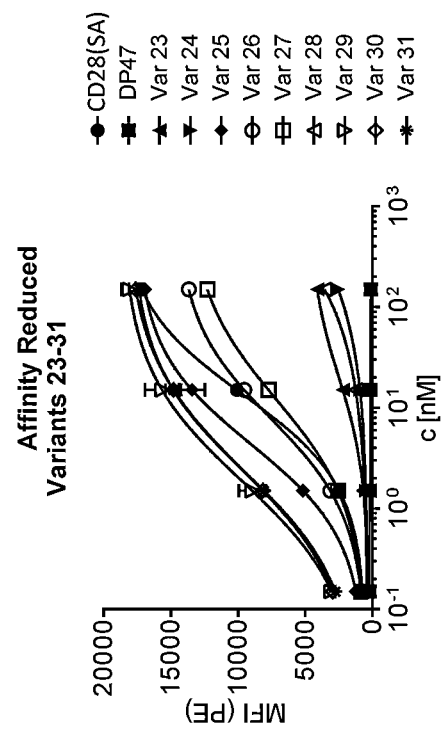

In FIGS. 4A to 4C the binding of affinity-reduced CD28 agonistic antibody variants in monospecific, monovalent IgG formats from supernatants to human CD28 on cells is shown. Median fluorescence intensities of binding to CHO cells expressing human CD28 (parental cell line CHO-kl ATCC #CCL-61, modified to stably overexpress human CD28) compared to the negative control (anti-DP47) and the original TGN1412, were assessed by flow cytometry. The binding curves of variants 1-10 are shown in FIG. 4A, those of variants 11 to 22 in FIG. 4B and those of variants 23 to 31 in FIG. 4C. Depicted are technical duplicates with SD.

Figure 4D:
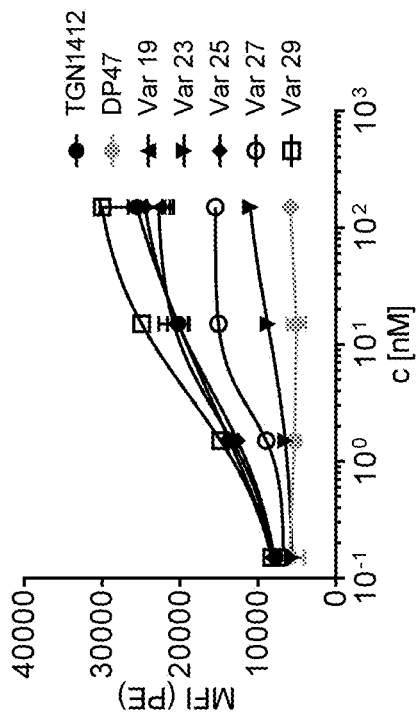
Figure 4E:
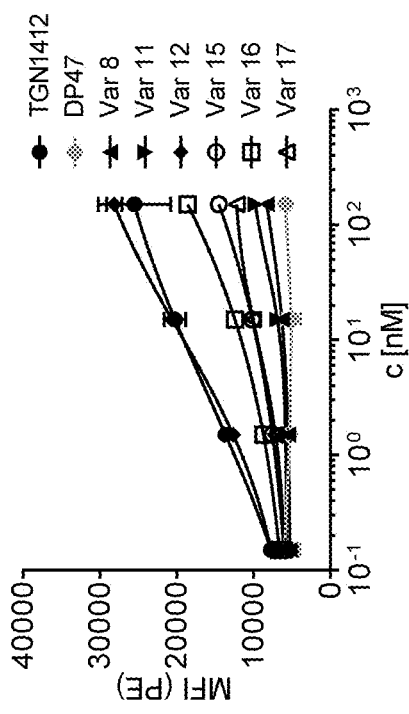
Figure 4F:
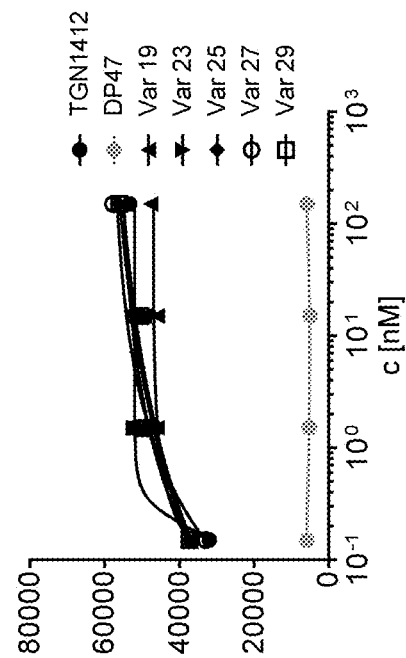
Figure 4G:
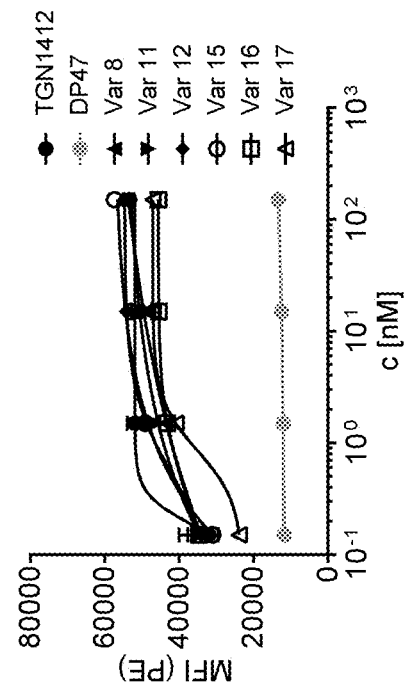

In FIGS. 4D and 4E, the binding of FAP-targeted bispecific CD28 agonistic antibody variants in huIgG1 PG-LALA 1+1 format with selected affinity-reduced CD28 agonistic antibody variants to human CD28 on cells is shown. The binding curves of bispecific 1+1 constructs with variants 8, 11, 12, 15, 16 and 17 are shown in FIG. 4D, whereas the binding curves of bispecific 1+1 constructs with variants 19, 23, 25, 27 and 29 are shown in FIG. 4E. Selected binders were chosen based on affinities for production in a 1+1, bispecific FAP-targeted format. In FIGS. 4F and 4G, the binding of the same FAP-targeted bispecific CD28 agonistic antibody variants in huIgG1 PG-LALA 1+1 format to human FAP is shown. Provided are median fluorescence intensities of binding to CHO cells expressing human CD28 (parental cell line CHO-kl ATCC #CCL-61, modified to stably overexpress human CD28) or to 3T3 cells expressing human FAP (NIH/3T3 cell line (ATCC CRL-1658)) compared to the negative control (anti-DP47) and to TGN1412 (Molecule A), assessed by flow cytometry. Shown are technical triplicates with SEM.

Figure 4I:
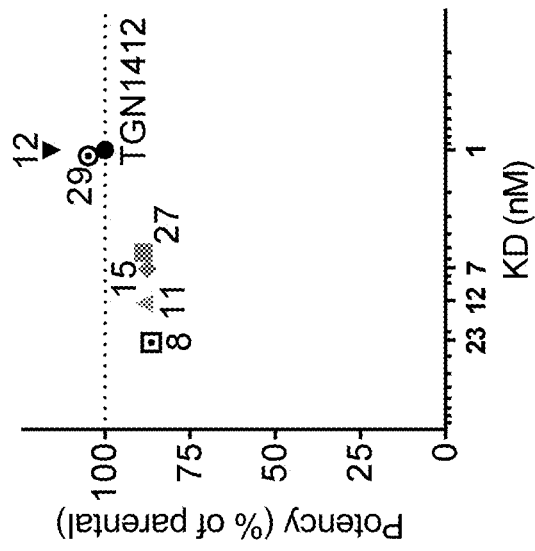
Figure 4H:
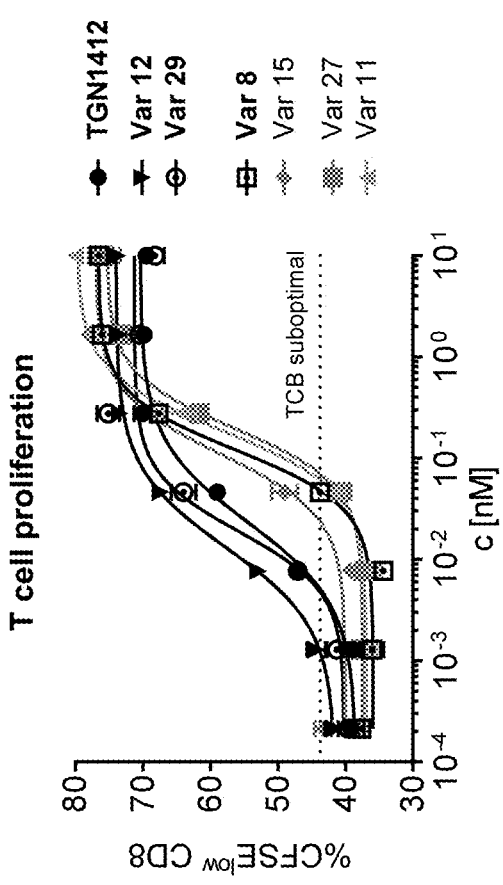
Figure 4J:
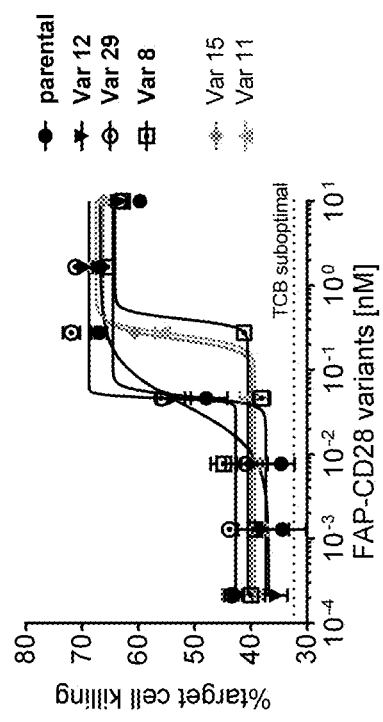

The in vitro potency of selected FAP-targeted bispecific CD28 agonistic antibody variants in huIgG1 PG-LALA 1+1 format is illustrated in FIGS. 4H, 4I and 4J. PBMC T cells were incubated with MCSP- and FAP-expressing MV3 melanoma cells for 5 days in the presence of limiting concentration of MCSP-TCB (5 pM, P1AD2189) and increasing concentration of FAP-CD28 constructs with the indicated CD28 variant binders. In FIG. 4H is shown the CFSE-dilution as measure for T cell proliferation of CD8 T cells, assessed by flow cytometry. Error bars show SEM, graphs depict technical triplicates of representative results from 2 donors. In FIG. 4I is shown the correlation of $K_D$ (nM) of the CD28 binder variant in relation to potency by area under the curve of (a) as % of the parental TGN1412 clone (CD28(SA)). In FIG. 4J the target cell killing at 90 h is shown.

FIGS. 5A to 5D refer to the establishment of high-density (HD) pre-culture and mode of action of CD28(SA). PBMC T cells were either pre-cultured at high density (HD) for 2 days or used fresh from PBMC isolation and stimulated with increasing concentrations of CD28(SA). Depicted is CFSE-dilution as proxy for T cell proliferation after 5 days of stimulation with CD28(SA) (Molecule A, P1AE1975) (FIG. 5A) and cytokine secretion after 2 days (FIG. 5B) of stimulation. FIG. 5C shows the percentage of FcγRIIb expression in PBMC monocytes and B cells before and after 2 days HD PBMC pre-culture, assessed by flow cytometry. FIG. 5D: HD pre-cultured PBMCs were co-cultured with CD28(SA) for 5 days in presence or absence of an FcγRIIb blocking antibody or isotype control and percentage of CFSE-dilution of CD4 T cells was assessed by flow cytometry. Graphs are representative of at least 6 donors (FIG. 5A, 5B) and 2 donors (FIG. 5C, 5D), each assessed in independent experiments. The graphs show technical triplicates. Error bars indicate SEM. Statistical analysis was performed by student's t-test. ***: p<0.001. Superagonism of CD28 (SA) IgG4 depends on cross-linking to FcγRIth.

Figure 6A:
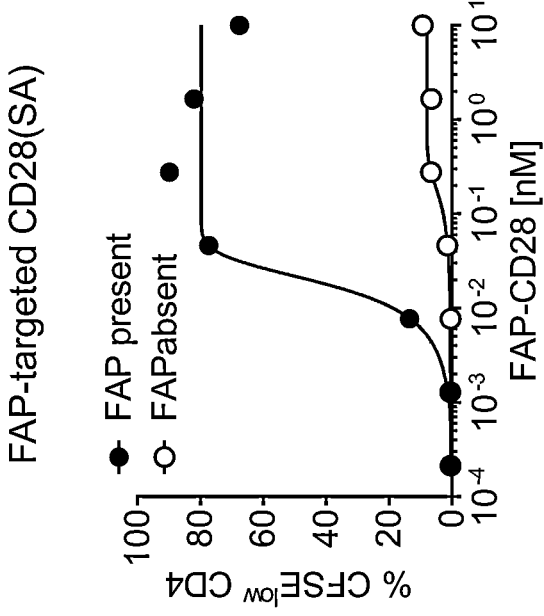
Figure 6B:
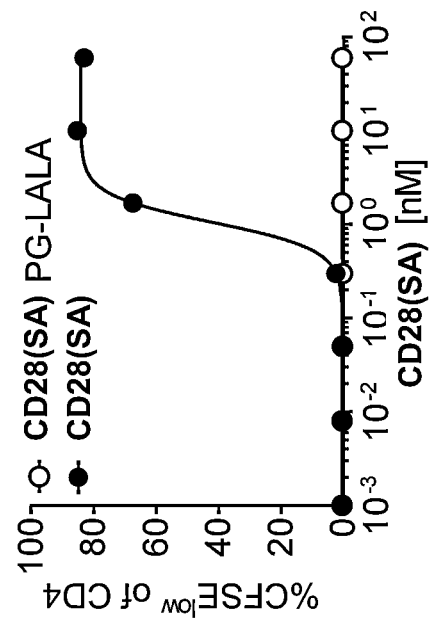

In FIGS. 6A and 6B the T cell proliferation, i.e. CFSE-dilution of CD4 T cells after 5 days of stimulation with either original Fc wild-type IgG4 CD28(SA) (P1AE1975) or CD28 (SA) bearing the P329G-LALA mutation (P1AD9289) is shown. T cells were pre-cultured at high density for 2 days. Graphs are representative of at least 3 independent experiments. Technical triplicates are shown. Fc-silencing abolishes superagonism in TGN1412. Adding a tumor-targeting moiety to Fc-silenced TGN1412 restores superagonism, which is then dependent on the presence of the tumor-target.

In FIGS. 7A, 7B, 7C and 7D a comparison of FAP-targeted CD28 agonists in different formats (2+2 and 1+2) and with superagonistic (CD28(SA)) binders and conventional agonistic binders (9.3, CD28(CA)) is shown. FAP-targeted CD28 agonists with conventional CD28 agonistic binders do not function as superagonists. PBMC T cells were co-cultured with 3T3-huFAP cells (FAP present) in the presence of increasing concentrations of the FAP-CD28 formats with superagonistic binders (SA, FIG. 7A) or conventional agonistic binders (9.3, FIG. 7B) for 5 days. T cell proliferation is shown. PBMC T cells were then also co-cultured with 3T3 WT cells (FAP absent), in the presence of increasing concentrations of the FAP-CD28 formats with superagonistic binders (SA, FIG. 7C) or conventional agonistic binders (9.3, FIG. 7D) for 5 days. Depicted is CFSE-dilution as measure for T cell proliferation of CD8 T cells, assessed by flow cytometry on day 5 post stimulation. Graphs show cumulative data from 3 donors in 3 independent experiments. Error bars show SEM. In the same experimental setup also cytokines were measured from supernatants after 2 days of co-culture. The values are provided in FIG. 7E.

The ability of FAP-CD28 in various formats with either superagonistic CD28(SA) binders or conventional agonistic binders (CD28(CA)) to induce killing of FAP-expressing RFP-MV3 melanoma cells was assessed over the course of 90 h by live cell imaging using the IncuCyte technology. All molecules including the FAP-TCB (P1AD4645) were used at 10 nM. FIGS. 8A, 8B and 8C show representative results from three donors with technical triplicates, respectively. FIG. 8D shows the cumulative results expressed as area under the curve (AUC) at t=90 h of 3 donors from 3 independent experiments. Boxes display 25th-75th percentiles, whiskers display min to max. Statistical analysis was performed by paired 1-way ANOVA. ***: $p<0.001$, ns: not significant.

A comparison of CEA-targeted CD28 agonists in different formats with superagonistic and conventional agonistic binders is shown in FIGS. 9A and 9B. The ability of CEA-CD28 in various formats with either superagonistic CD28(SA) binders or conventional agonistic binders (CD28 (CA)) to induce killing of CEA-expressing RFP$^+$ MKN45 gastric cancer cells was assessed over the course of 90 h by live cell imaging using the IncuCyte technology. All molecules including the CEACAM5-TCB (P1AD5299) were used at 10 nM. FIG. 9A shows representative results from one donor with technical triplicates. FIG. 9B shows the statistical analysis of technical triplicates expressed as area under the curve (AUC) at t=90 h of 1 donor in 1 experiment. Boxes display 25th-75th percentiles, whiskers display min to max. Statistical analysis was performed by paired 1-way ANOVA. ***: $p<0.001$. It is shown that CEA-targeted CD28 agonists with conventional CD28 agonistic binders do not behave superagonistically.

Figure 10B:
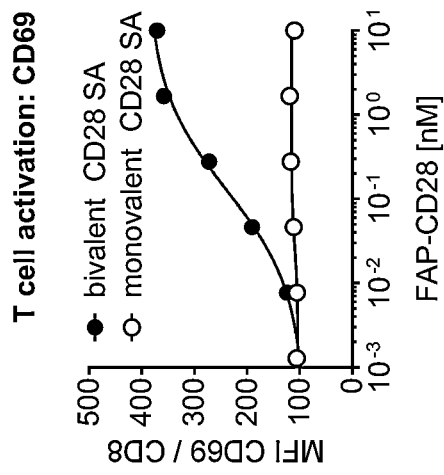
Figure 10A:
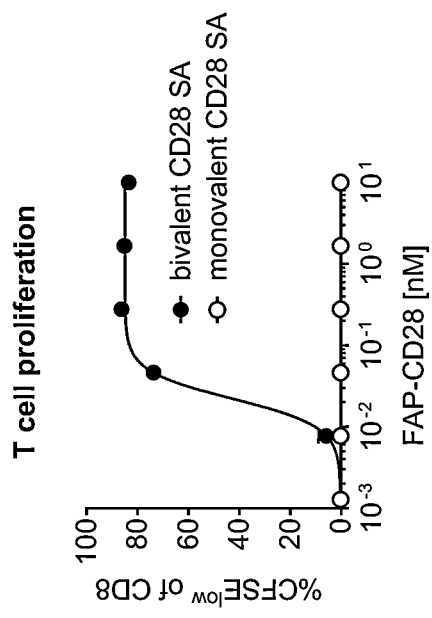
Figure 10C:
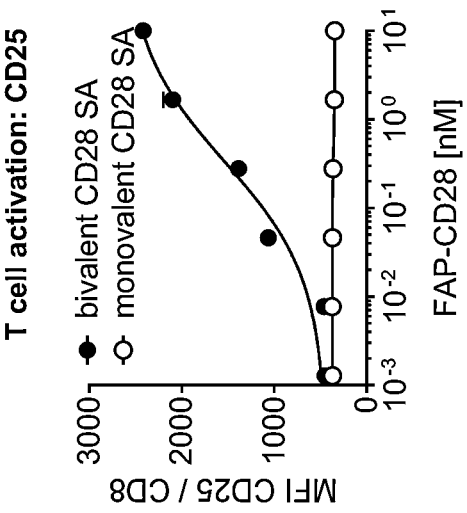

In FIGS. 10A, 10B and 10C it is shown that targeted CD28 agonists with monovalent superagonistic binders are not functionally superagonistic. PBMC T cells were co-cultured for 5 days with 3T3-huFAP cells in presence of increasing concentrations of FAP-CD28 with bivalent CD28 binders (P1AD9011, closed circles) or FAP-CD28 with monovalency for CD28 binding (P1AD4492, open circles). In FIG. 10A CFSE-dilution of CD8 T cells is shown. Furthermore, activation of T cells was assessed by detection of activation markers CD69 (FIG. 10B) and CD25 (FIG. 10C) by flow cytometry. Mean fluorescent intensity (MFI) of CD69 and CD25 stainings are shown at 5 days post stimulation. Technical triplicates from 1 donor are shown, error bars indicate SEM. It is shown that TGN1412-like superagonism requires multivalent CD28 binding.

Figure 11B:
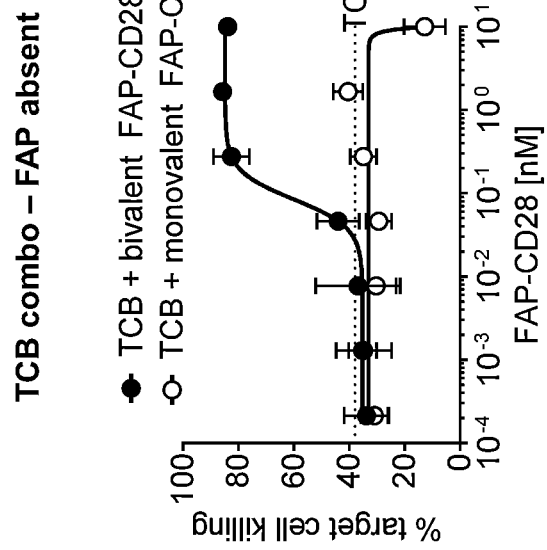
Figure 11A:
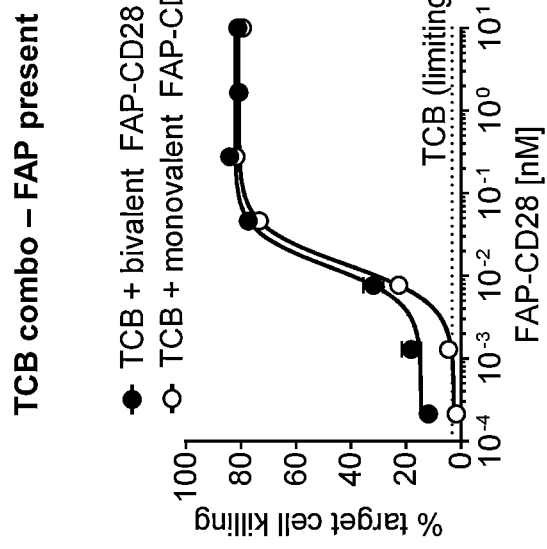

FIGS. 11A and 11B show that if combined with T cell bispecific antibodies (TCBs) TCB-mediated effector functions are supported by monovalent and bivalent CD28 binding of FAP-targeted agonistic CD28 antigen binding molecules with comparable potency, but CD28 binder monovalency is required to maintain tumor target dependence of CD28 agonists in the presence of TCBs. In FIG. 11A, for the presence of FAP, PBMC T cells were incubated with MCSP- and FAP-expressing MV3 melanoma cells for 90 h in the presence of a combined limiting concentration of MCSP-TCB (5 pM, P1AD2189) and increasing concentration (range 0-10 nM) of FAP-CD28(SA) with bivalent or monovalent binding to CD28, respectively. Depicted is target cell killing at 90 h as assessed by live cell imaging using the IncuCyte technology. In FIG. 11B, PBMC T cells were co-cultured for 90 h with FAP-negative CEA-expressing MKN45 gastric cancer cells (FAP absent) in the presence of limiting concentrations of CEACAM5-TCB (10 pM, P1AD5299) in combination and increasing concentration (range 0-10 nM) of FAP-CD28 with bivalent or monovalent CD28 binding, respectively. Depicted is target cell killing at 90 h as assessed by IncuCyte. Data show killing of MKN45 target cells over time, from 1 donor in 1 experiment, technical triplicates, error bars indicate SEM.

Figure 12A:
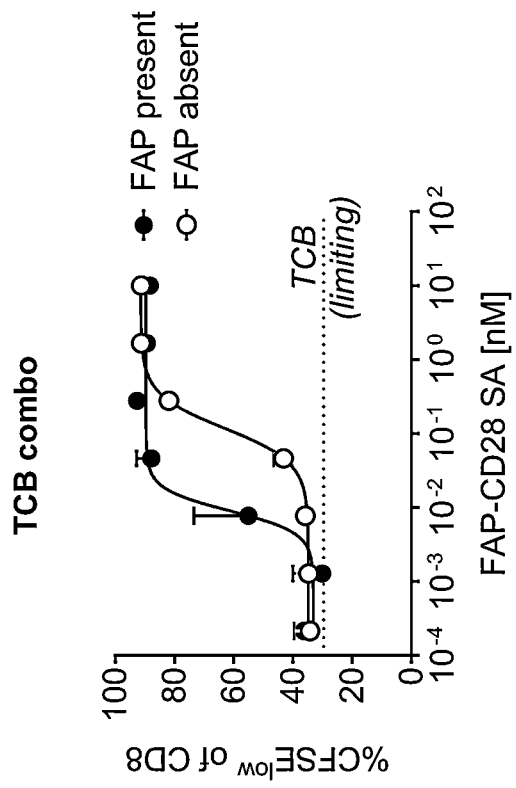
Figure 12B:
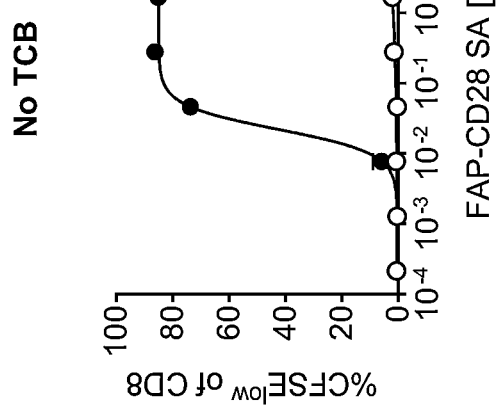

In FIGS. 12A and 12B it is shown that FAP-CD28(SA) with bivalent binding to CD28 loses FAP-dependence when combined with T cell bispecifics. In FIG. 12A no TCB is present. PBMC T cells were either co-cultured with CEA-expressing MKN45 and 3T3-huFAP ("FAP present" condition, closed circles) or 3T3-WT ("FAP absent" condition, open circles), respectively, in the presence of increasing concentrations of FAP-CD28(SA) 2+1. The combination with TCB is shown in FIG. 12B. PBMC T cells were either co-cultured with CEA-expressing MKN45 and 3T3-huFAP ("FAP present" condition, closed circles) or 3T3-WT ("FAP absent" condition, open circles), respectively, in the presence of limiting concentrations of CEACAM5-TCB (10 pM, P1AD5299) and increasing concentrations of FAP-CD28 2+1 SA. Shown is CD8 T cell proliferation after 5 days of stimulation. Data are representative of 2 independent experiments with 2 donors. Results from one donor are shown, data points represent technical triplicates, error bars indicate SEM.

Figure 13A:
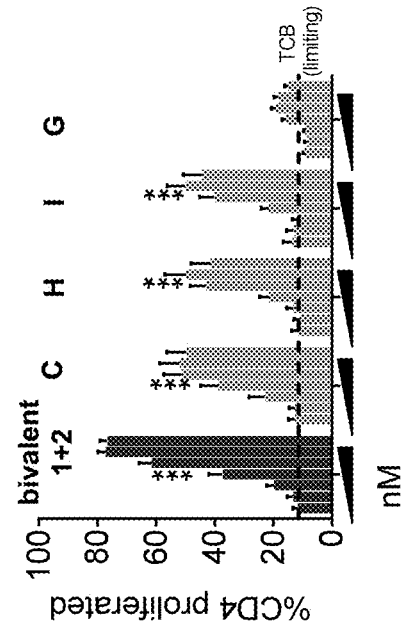
Figure 13B:
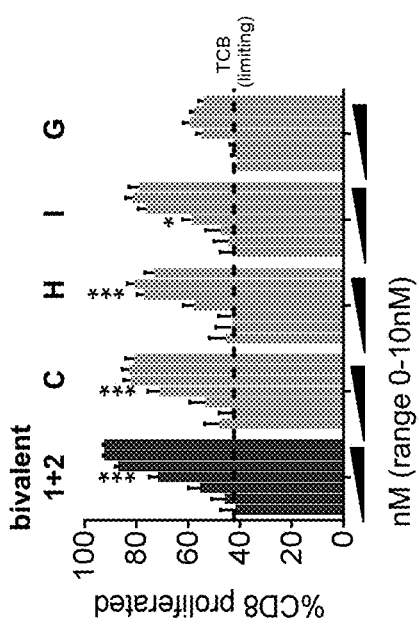
Figure 13C:
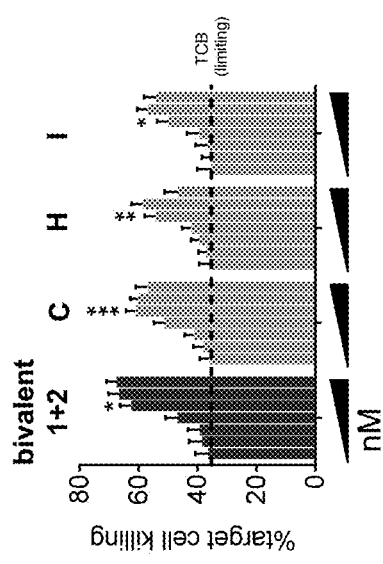

FIGS. 13A, 13B and 13C show the functionality of FAP-CD28(SA) antigen binding molecules with monovalent binding to CD28 in different formats. Molecule C is a FAP-CD28(SA) classical 1+1 format (P1 AD4492), Molecule H is a FAP-CD28(SA) 1+1 "head-to-tail" (H2T) format (P1AE2021), Molecule I is a FAP-CD28(SA) 1+1 format with C-terminal fusion of the FAP binder (P1AE2236) and Molecule G is a FAP-CD28(SA) 2+1 format (P1AD5231). As reference the bivalent CD28 antigen binding molecule (P1AD9011) was used. PBMC T cells were incubated with MCSP- and FAP-expressing MV3 melanoma cells in the presence of limiting concentration of MCSP-TCB (5 pM, P1AD2189) and increasing concentration (range 0-10 nM) of FAP-CD28 in the given formats. Depicted is CFSE-dilution as measure for T cell proliferation of CD8 (FIG. 13A) and CD4 T cells (FIG. 13B) after 5 days, assessed by flow cytometry. FIG. 13C: Shown is killing of MV3 cells over 84 hours in presence of 5 pM MCSP-TCB alone compared to combination of 5 pM MCSP-TCB and increasing concentrations of FAP-CD28 in the various formats. Killing was assessed by live cell imaging using the IncuCyte system. All molecules were able to support TCB-mediated effector functions. Graphs depict cumulative data from 3 independent experiments and 4 donors 10 pM MCSP-TCB; E:T 20; Statistics: 2-way ANOVA. Stars indicate lowest concentration at which add-on is significant over TCB alone: *$p≤0.05$, $p≤0.01$; *$p≤0.001$. Error bars indicate SEM.

Target cell killing of CEA-CD28 1+1 format in combination with TCB is shown in FIG. 14. PBMC T cells were co-cultured for 90 h with CEA-expressing MKN45 gastric cancer cells in presence of limiting concentrations of CEACAM5-TCB (10 pM, P1AD5299) in combination with 2 nM of CEA-CD28 (P1AE3127) or untargeted CD28 (P1AD8944). Data show killing of MKN45 target cells over time, from 1 donor in 1 experiment. Killing was assessed by live cell imaging using the IncuCyte system. It is shown that only the combination leads to target cell killing, at the given concentration the molecules alone do not induce killing. CEA-CD28 synergizes with CEACAM5-TCB.

In FIG. 15 it is shown that CEA-CD28 enhances CEA-TCB and CEACAM5-TCB and lowers the threshold of CEA-expression for TCBs to induce T cell activation. PBMC T cells were incubated with increasing concentrations of either CEA-TCB (P1AD4646) or CEACAM5-TCB (P1AD5299) and fixed concentrations of CEA-CD28 (P1AE3127) in presence of target cell lines with different CEA expression levels: (i) MKN45 (high expression, approx. 400 000 CEA binding sites/cell), (ii) Lovo (medium expression, approx. 60 000 CEA binding sites/cell), (iii)

HT-29 (low expression, approx. 6 000 CEA binding sites/ cell). T cell proliferation was assessed as proxy of T cell activation by flow cytometry.

Figure 16:
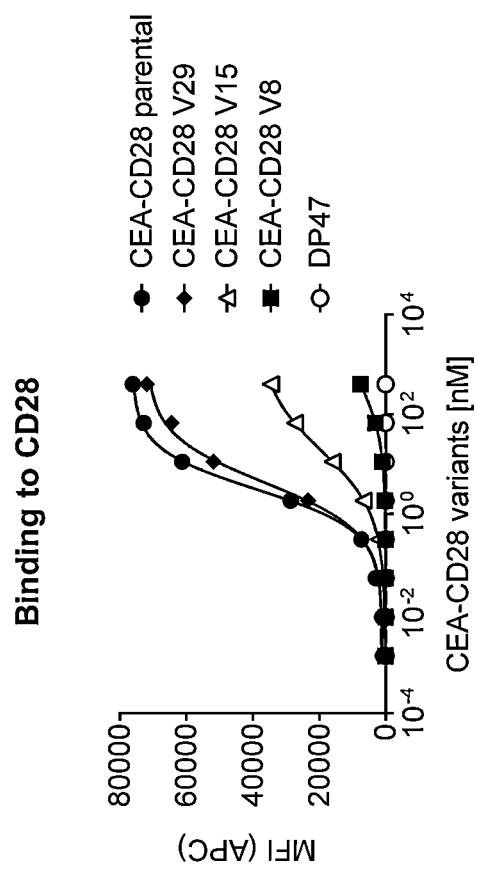

The binding of selected affinity reduced CD28 binder variants in a bispecific CEA-targeted monovalent 1+1 format to CD28 on cells is shown in FIG. 16. Median fluorescence intensities of binding of the CEA-CD28 antibodies or anti-DP47 antibody (negative control) to CHO cells expressing human CD28 (parental cell line CHO-kl ATCC #CCL-61, modified to stably overexpress human CD28) was assessed by flow cytometry. Shown are technical triplicates with SEM.

Figure 17A:
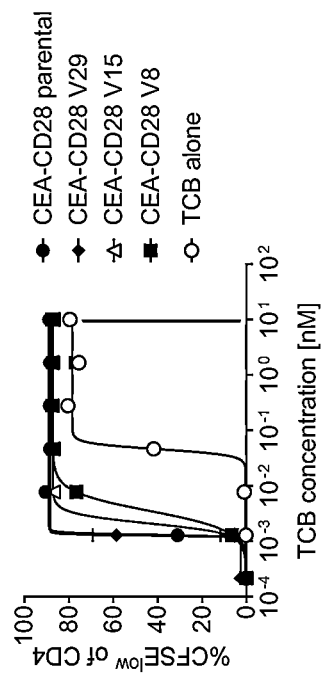
Figure 17B:
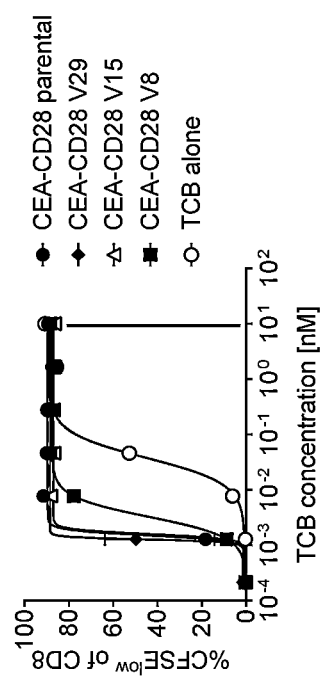
Figure 17C:
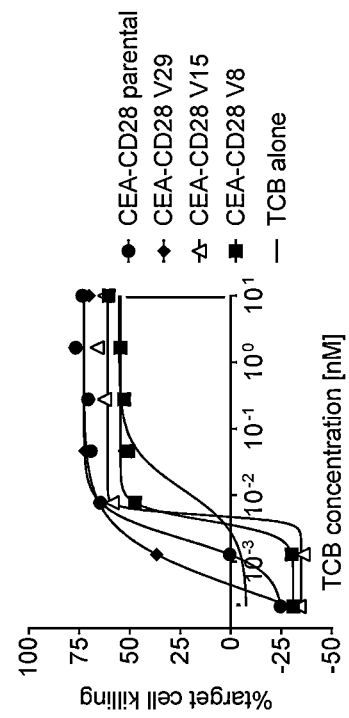

FIGS. 17A, 17B and 17C show the functionality of selected affinity reduced CD28 binder variants in a bispecific CEA-targeted monovalent 1+1 format. PBMC T cells were co-cultured with CEA-expressing MKN45 gastric cancer cells in presence of limiting concentrations of CEACAM5-TCB (10 pM, P1AD5299) in combination with 2 nM of the CEA-CD28 1+1 molecules with the CD28 binder variants. CD8 T cell proliferation (FIG. 17A) and CD4 T cell proliferation (FIG. 17B) was assessed by CFSE-dilution by flow cytometry after 5 days of co-culture. Target cell killing was assessed after 90 h of incubation (FIG. 17C). Data show killing of MKN45 target cells over time, from 1 donor in 1 experiment. All molecules are able to support CEACAM5-TCB mediated effector functions.

Figure 18:
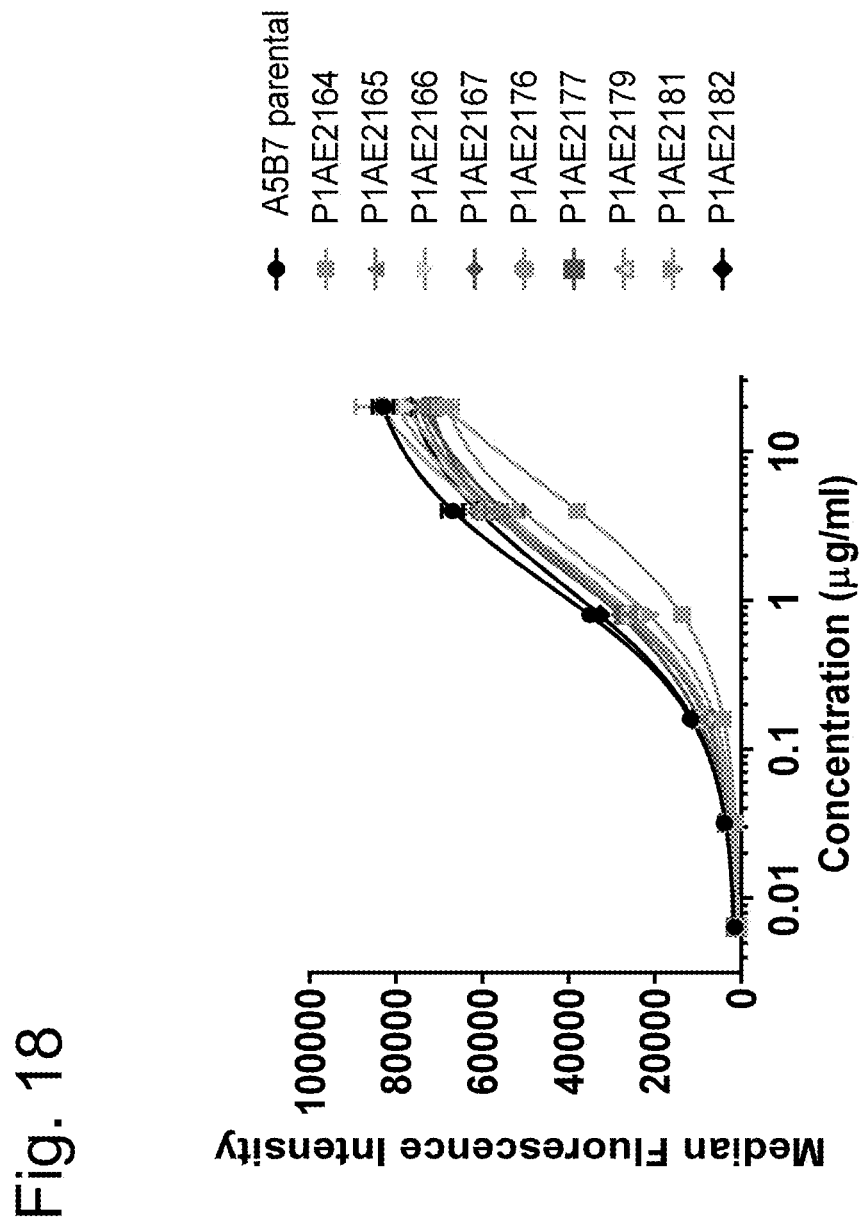

FIG. 18 shows the binding of humanized CEA(A5B7) huIgG1 P329G LALA variants to MKN-45 as compared to the binding of the parental murine A5B7 antibody. Antibodies were detected with a fluorescently labeled secondary antibody and fluorescence was measured by flow cytometry.

FIGS. 19A to 19C are schematic illustrations of the recombinant proteins displaying different domains of the CEACAM5 protein that were used as antigens in the phage display campaign. FIG. 19A shows construct NABA-avi-His consisting of the 4 Ig-like domains N, A1, B and A2. FIG. 19B shows the construct N(A2B2)A-avi-His and FIG. 19C illustrates the construct NA(B2)A-avi-His.

FIGS. 20A and 20B show the VH and VL sequences, respectively, of humanized CEA antibody A5H1EL1D wherein the randomized positions are marked with X.

Figure 21C:
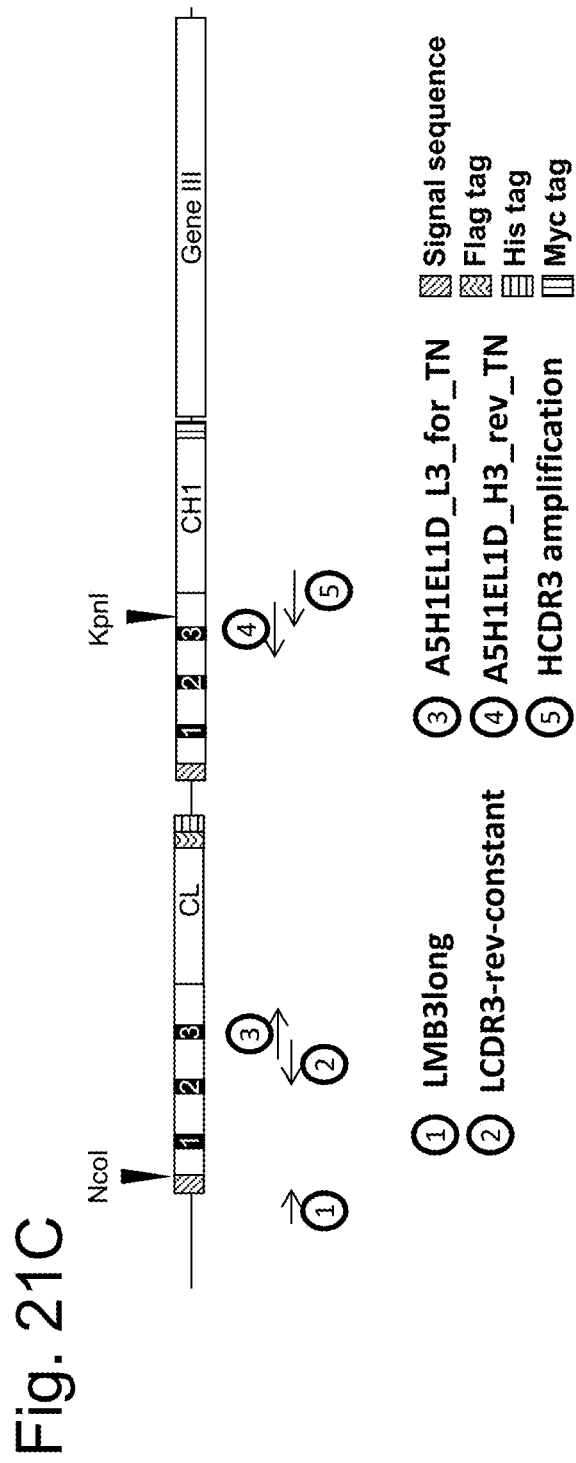

Schematic drawings of the phage vectors of the affinity maturation libraries are shown in FIG. 21A (CDRH1/H2 affinity maturation library), FIG. 21B (CDRL1/H2 affinity maturation library) and FIG. 21C (CDRH3/CDRL3 amplification library).

Figures 22A, 22B:
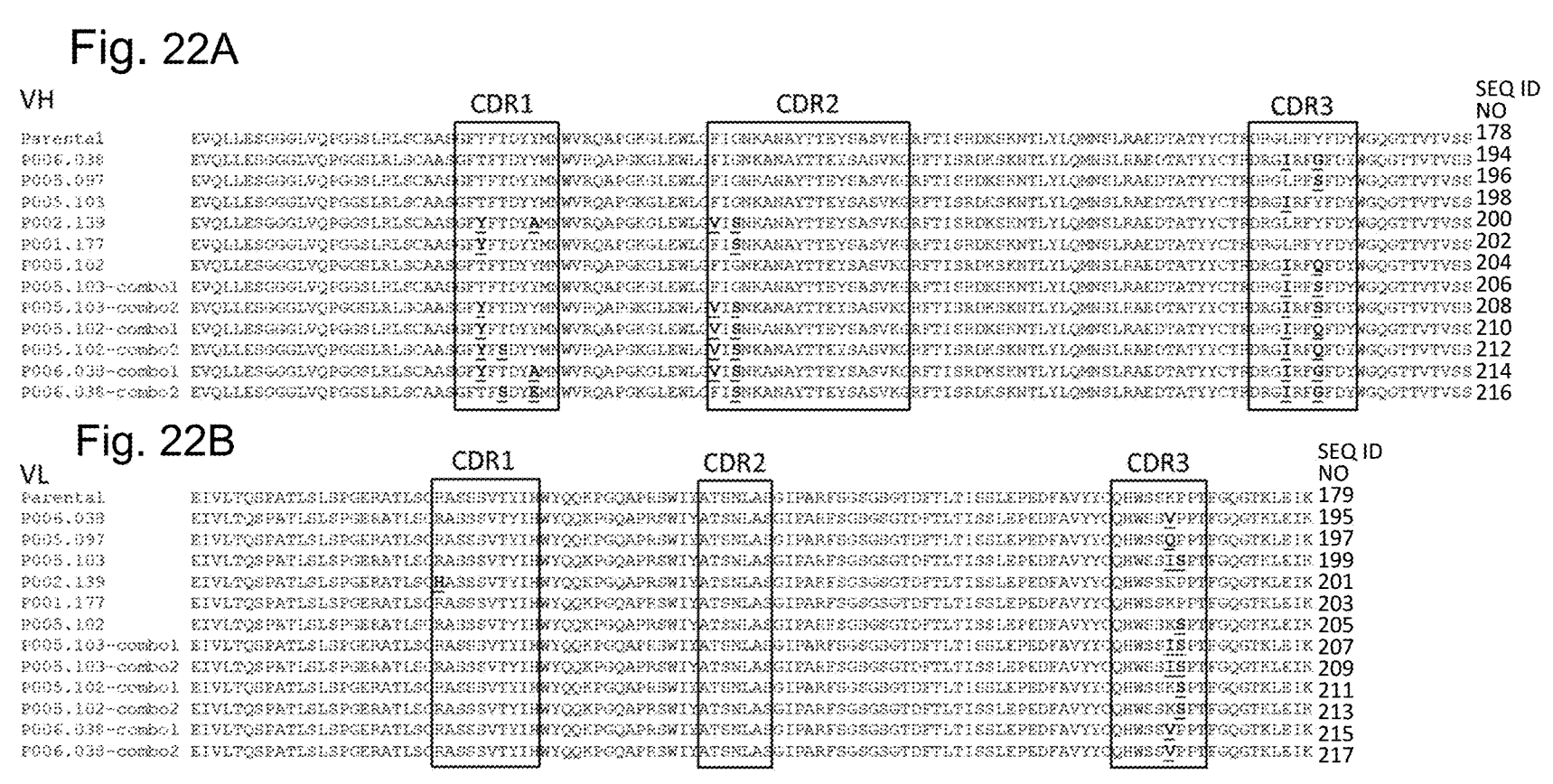

FIGS. 22A and 22B show an alignment of the VH amino acid sequences (FIG. 22A) and VL amino acid sequences (FIG. 22B) of the affinity-matured, humanized CEA (A5H1EL1D) antibody variants.

In FIGS. 23A to 23D schematic illustrations of bispecific CEA/CD28 antigen binding molecules as described in Example 11 are shown.

FIG. 23A shows a bispecific CEA-CD28 antigen binding molecule in 1+1 format, wherein the CEA antigen binding domain is represented as crossFab (VH/VL exchange) and in the Fab fragment bearing the CD28 antigen binding domain there are charged modifications in order to support the correct pairing of the light chains. The Fc domain has knob into hole modifications and the P329G LALA mutations to abrogate the binding to Fcγ receptors. In FIG. 23B the CD28 antigen binding domain is represented as crossFab (VH/VL exchange) and the Fab fragment bearing the CEA antigen binding domain comprises the charged modifications. FIG. 23C illustrates a bispecific CEA-CD28 antigen binding molecule in 2+1 format, wherein the CD28 antigen binding domain is represented as crossFab and two Fab fragments with CEA antigen binding domains are fused to each other via the heavy chain (head-to tail).

FIG. 23D illustrates a bispecific CEA-CD28 antigen binding molecule in 2+1 format, wherein the CD28 antigen binding domain is represented as crossFab that is fused at its C-terminus to the N-terminus of one of the heavy chains of the "bivalent" CEA antibody ("classical" format).

In FIG. 24 it is shown that affinity-matured anti-CEA clone P002.139 shows improved binding to CEACAM5 on CEA-expressing MV3 cells. Shown is binding of CEA-CD28 bispecific antibodies carrying either the affinity-matured anti-CEA clone P002.139 or the parental A5H1EL1D clone. Median fluorescence intensities of binding of the CEA-CD28 bispecific antibodies or anti-DP47 antibody (negative control) to MV3 cells genetically engineered to express human CEACAM5 was assessed by flow cytometry. Shown are technical duplicates with SEM. Graph is representative of 3 independent experiments.

In FIGS. 25A and 25B it is shown that affinity-matured anti-CEA clone P002.139 shows improved functionality in an IL-2 reporter assay. Shown is luminescence readout after 6 h of co-incubation of MKN45 cells, IL-2 reporter cells with 5 nM CEA-TCB and CEA-CD28 carrying either the affinity-matured clone P002.139 or the parental clone A5H1EL1D. FIG. 25A shows dose response. Dotted line indicates luminescence achieved by CEA-TCB alone. In FIG. 25B the Area under the curve values calculated from data depicted in FIG. 25A are shown. Provided are technical duplicates with SEM. Graph is representative of 3 independent experiments.

Figure 26:
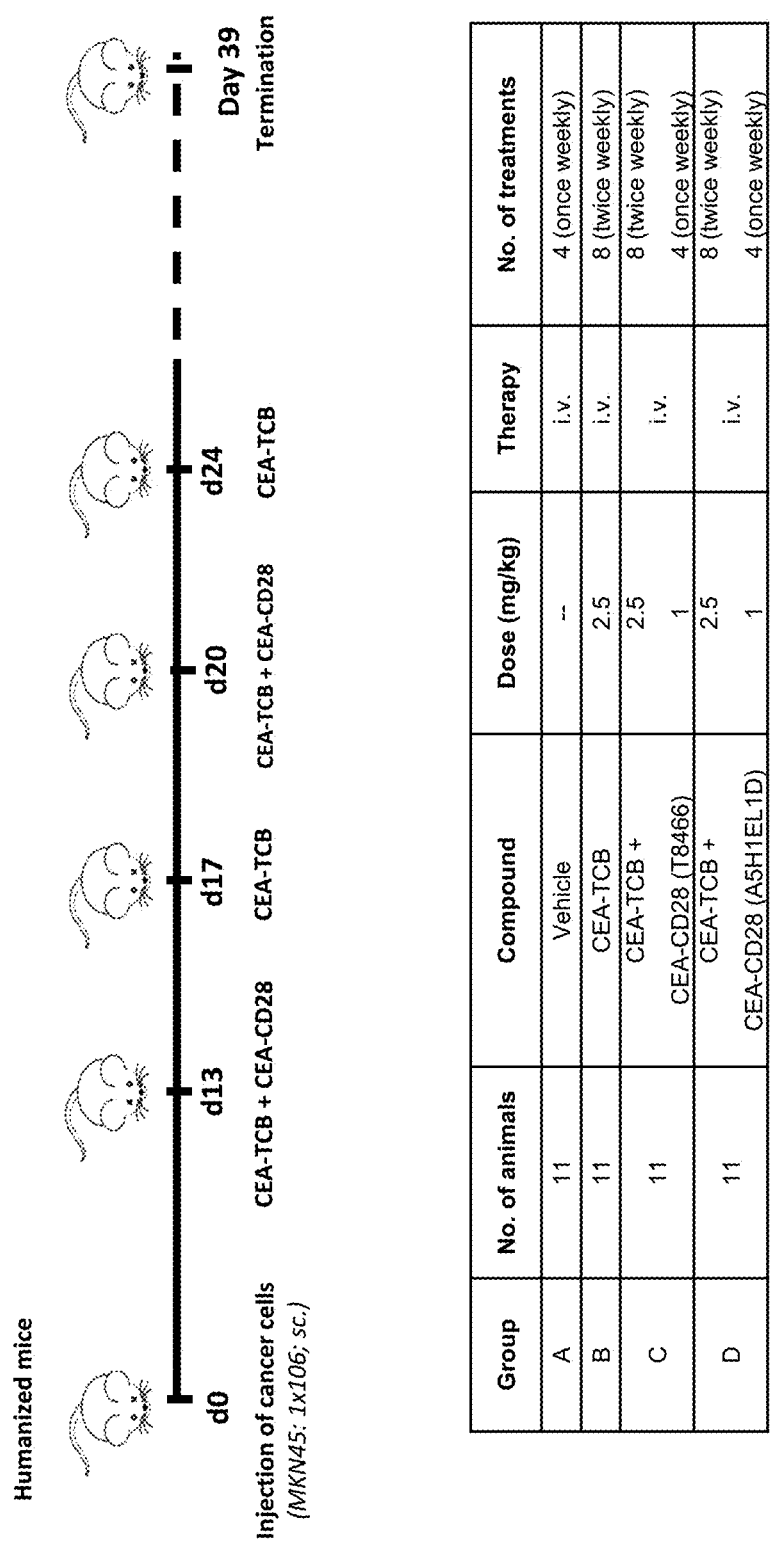

FIG. 26 shows the study design of an efficacy study with bispecific CEA-CD28 antibodies (comparison of different CEA clones) in combination with CEA TCB in MKN45 Xenograft in humanized mice. Shown is the design and the different treatment groups.

Figure 27B:
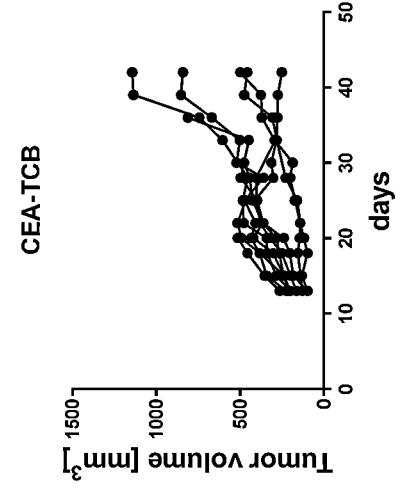
Figure 27C:
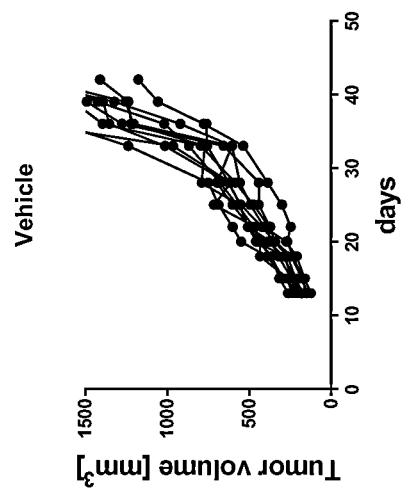
Figure 27D:
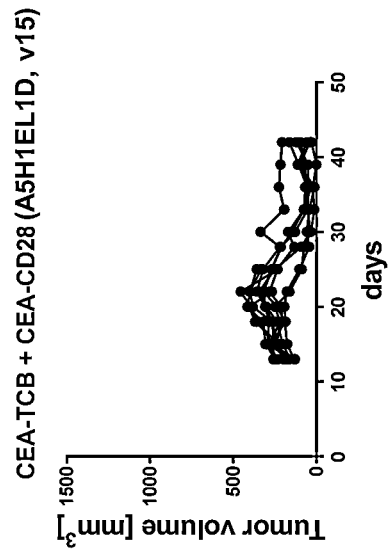
Figure 27E:
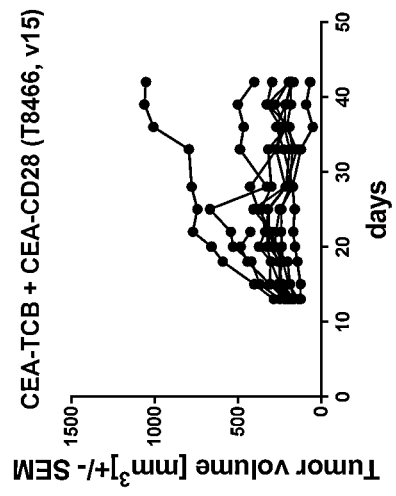

FIGS. 27A to 27E show results of the efficacy study with CEA-CD28 and CEA TCB combination in MKN45 Xenograft in humanized mice. Shown is the average tumor volume (FIG. 27A) or the growth of tumors in individual mice for the four treatment groups as plotted on the y-axis (FIG. 27B to 27E). FIG. 27B shows the tumor growth for each individual mouse in the vehicle group, FIG. 27C of the mice treated with CEA TCB alone, FIG. 27D of mice treated with CEA TCB and CEA(T84.66)-CD28 (SA_Variant 15) and FIG. 27E of mice treated with CEA TCB and CEA (A5H1EL1D)-CD28 (SA_Variant 15). It can be seen that there is increased TCB-mediated tumor regression in the presence of both bispecific CEA-CD28 antibodies.

Figure 28:
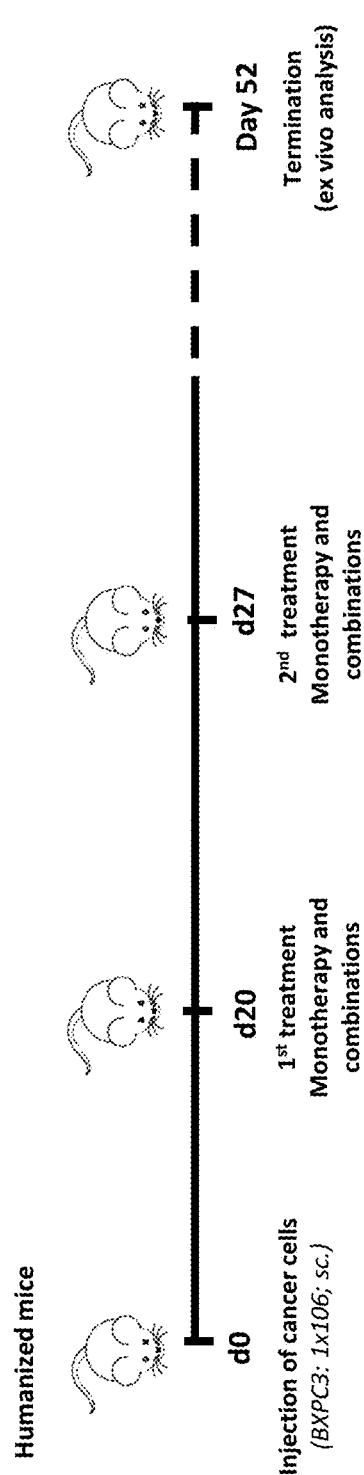

FIG. 28 shows the study design of an efficacy study with bispecific CEA-CD28 antibodies (comparison of different CD28 clones) in combination with CEACAM5 TCB in BXPC3 Xenograft in humanized mice. Shown is the design and the different treatment groups.

Figure 29:
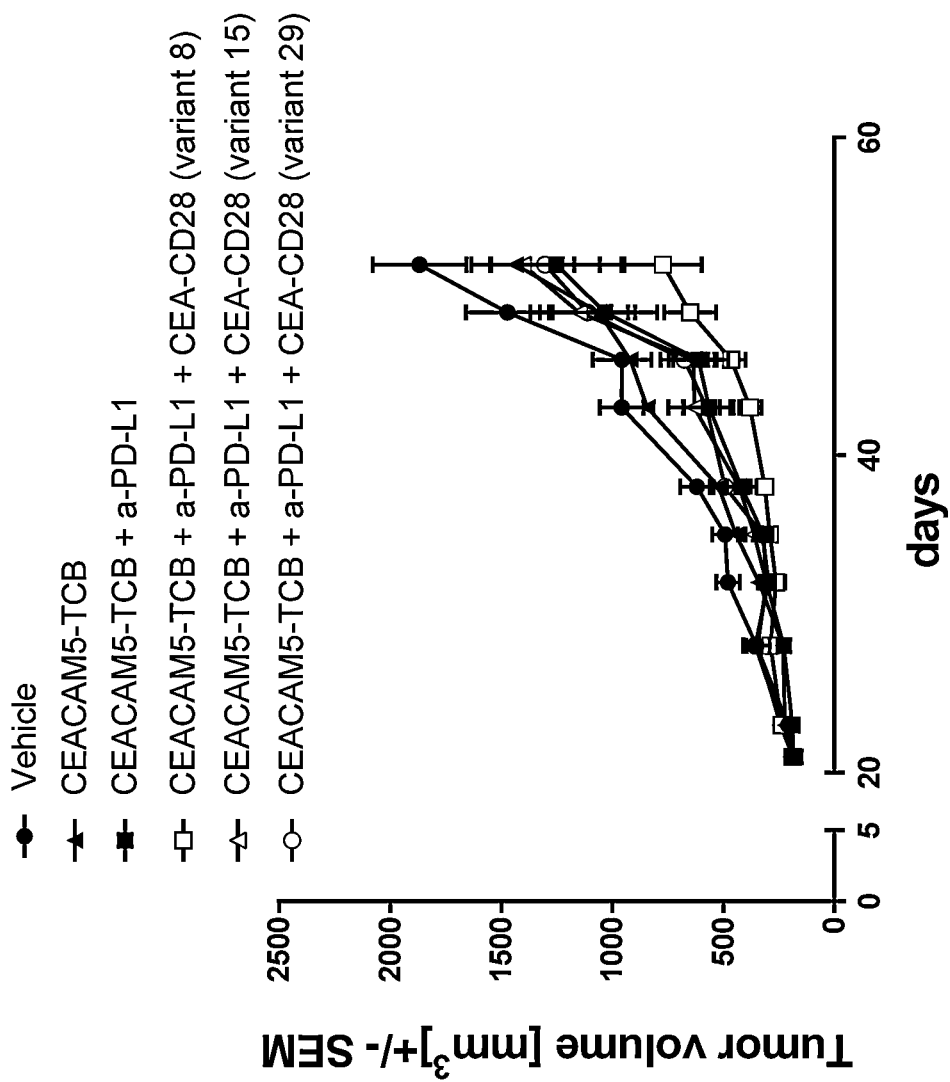

FIG. 29 shows the tumor growth kinetics (Mean, +SEM) for all treatment groups, the corresponding TGI values of each treatment arm are shown in Table 33 (Example 13.2).

The ex vivo Immuno-PD data are shown in FIGS. 30A to 30D. FIG. 30A shows representative dot plots (CD3 against CD45 and CD4 against CD8) of the stained tumor single cell suspensions of each treatment arm. The summary of CD3, CD8 and CD4 T cell infiltration is depicted in FIG. 30B (CD3), FIG. 30C (CD8) and FIG. 30D (CD4), respectively.

Figure 31:
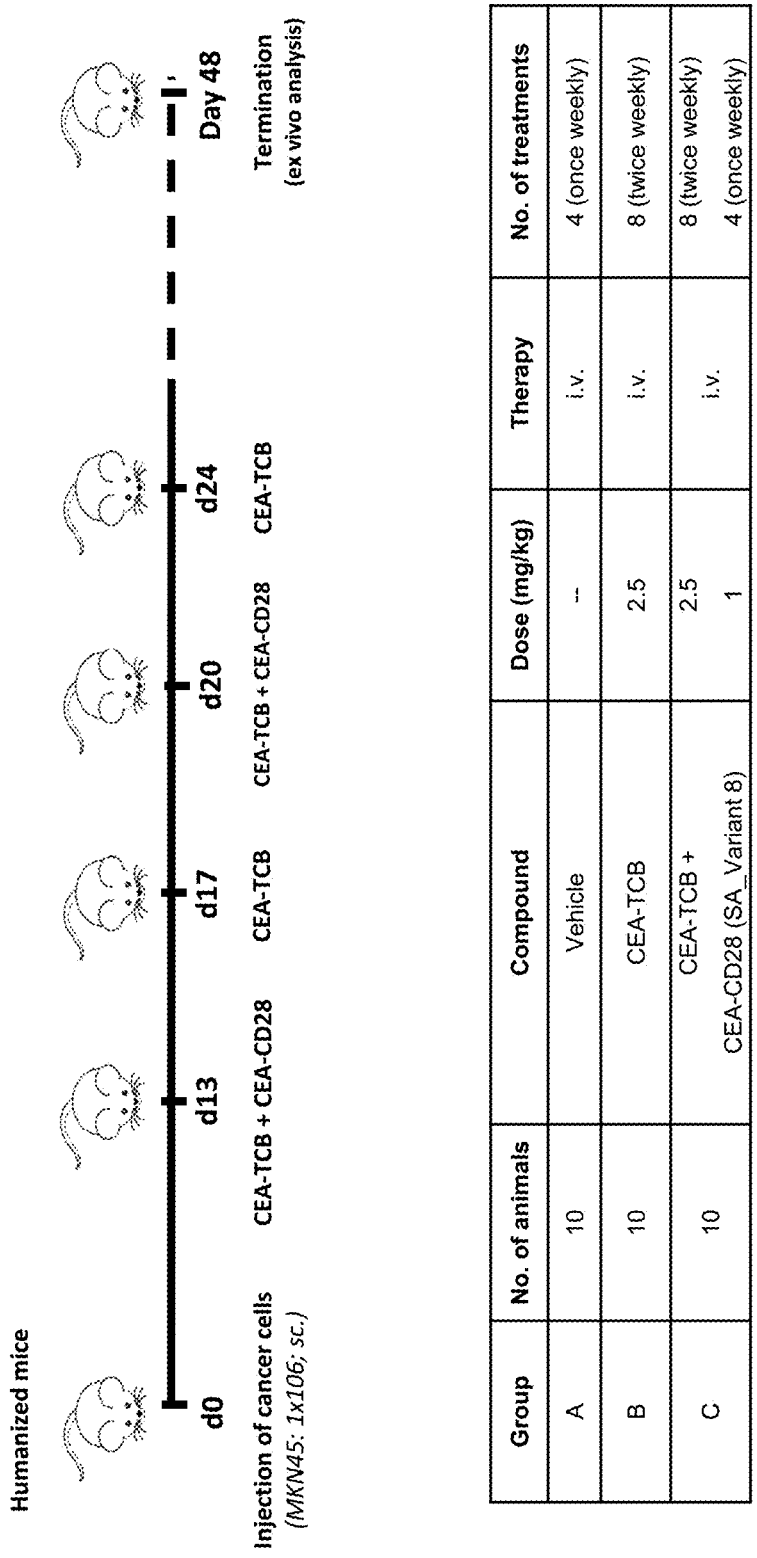

FIG. 31 shows the study design of an efficacy study with bispecific CEA-CD28 antibody (CEA(A5H1EL1D)-CD28 (SA_Variant 8)) in combination with CEA TCB in MKN45 Xenograft in humanized mice. Shown is the design and the different treatment groups.

Figure 32:
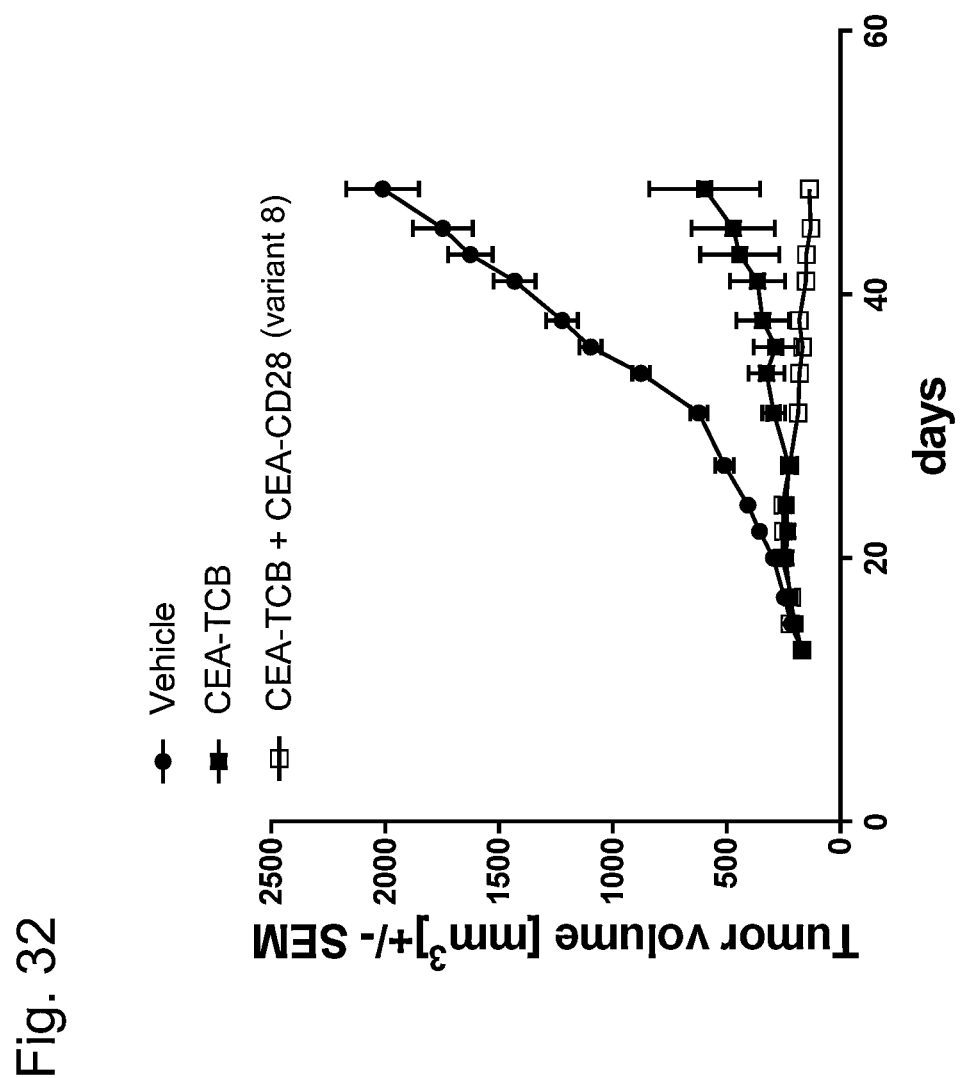

FIG. 32 shows the tumor growth kinetics (Mean, +SEM) for all treatment groups, the corresponding TGI values of each treatment arm are shown in Table 35 (Example 13.3).

Figure 33A:
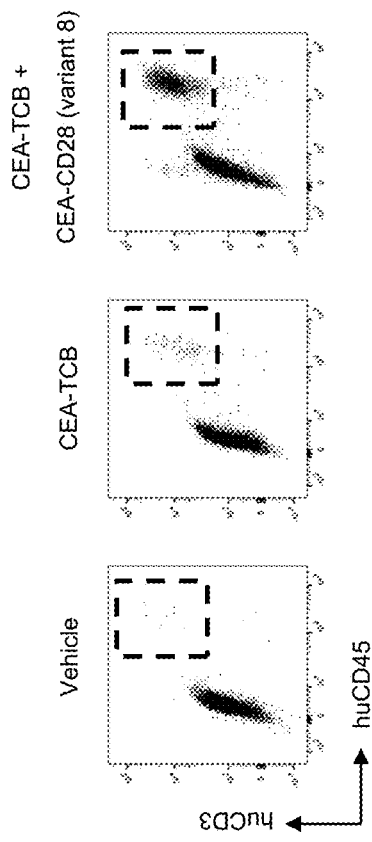
Figure 33B:
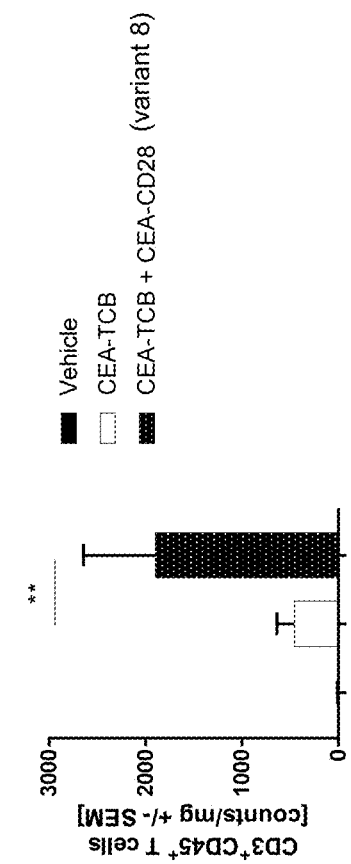

The ex vivo Immuno-PD data are shown in FIGS. 33A and 33B. FIG. 33A shows representative dot plots of the stained tumor single cell suspensions of each treatment arm. The summary of CD3+ T cell infiltration is depicted in FIG. 33B.

In FIGS. 34A to 34D schematic illustrations of bispecific CD28 antigen binding molecules as described in Example 14 are shown.

Figure 34B:
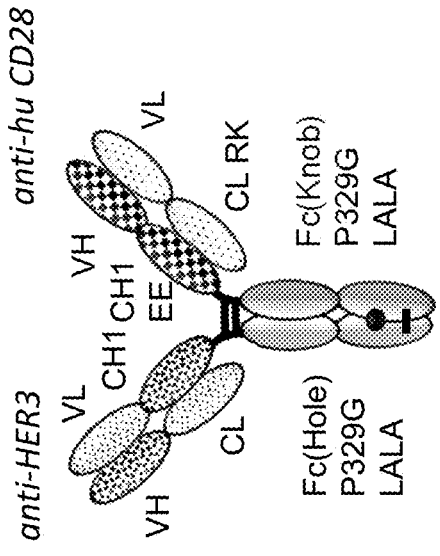
Figure 34D:
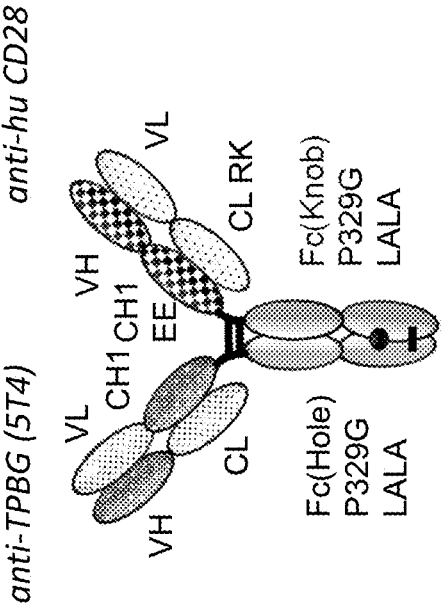
Figure 34A:
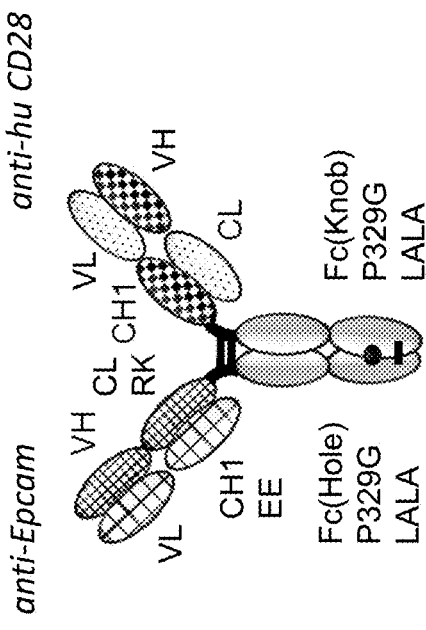

FIG. 34A shows a bispecific EpCAM-CD28 antigen binding molecule in 1+1 format, wherein the CD28 antigen binding domain is represented as crossFab (VH/VL exchange) and in the Fab fragment bearing the EpCAM antigen binding domain there are charged modifications in order to support the correct pairing of the light chains. The Fc domain has knob into hole modifications and the P329G LALA mutations to abrogate the binding to Fcy receptors.

In FIG. 34B the Fab bearing the CD28 antigen binding domain comprises charged modifications and the Fab bearing the HERS antigen binding domain is represented as crossFab (VH/VL exchange).

Figure 34C:
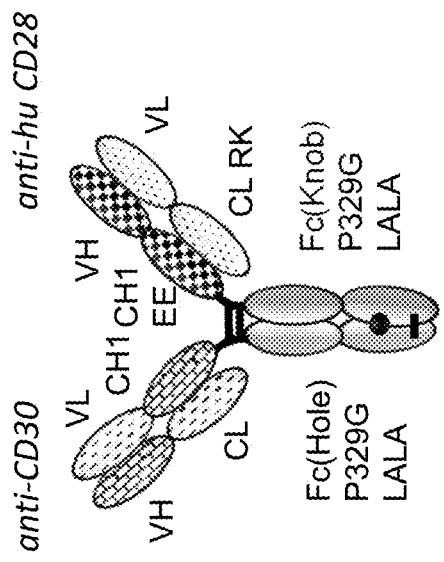

FIG. 34C illustrates a bispecific CD30-CD28 antigen binding molecule in 1+1 format, wherein Fab molecule bearing the CD28 antigen binding domain comprises charged modifications and the Fab bearing the CD30 antigen binding domain is represented as crossFab (VH/VL exchange).

FIG. 34D illustrates a bispecific TPBG-CD28 antigen binding molecule in 1+1 format, wherein Fab molecule bearing the CD28 antigen binding domain comprises charged modifications and the Fab bearing the TPBG (5T4) antigen binding domain is represented as crossFab (VH/VL exchange).

Figure 35A:
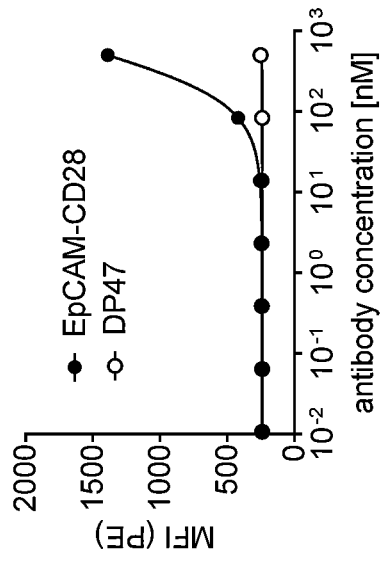
Figure 35B:
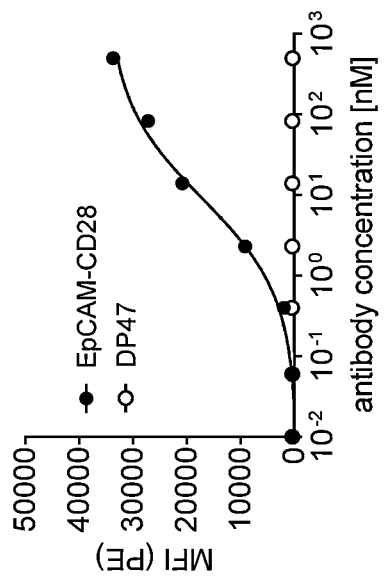
Figure 35C:
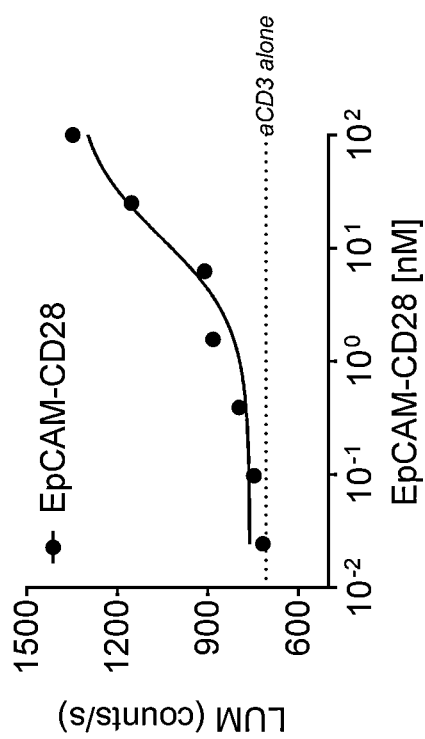

FIGS. 35A to 35C relate to the functional characterization of EpCAM-CD28 bispecific antigen binding molecules. In FIG. 35A it is shown that EpCAM-CD28 (Molecule 14A) binds to human CD28 on CHO-k1 cells expressing CD28, assessed by flow cytometry. The binding to EpCAM on HT29 cells, assessed by flow cytometry, is shown in FIG. 35B. Anti-DP47 served as negative control for unspecific binding of antibody compounds to cells. Dots represent means of technical duplicates. In FIG. 35C it is shown that EpCAM-CD28 (P1AE9051) enhances T cell responses to anti-CD3 stimulus in the IL-2 reporter assay. Shown is IL-2 reporter cell activation measured by luminescence readout after 6 hours of co-incubation with HT-29 in presence of suboptimal concentrations of anti-CD3 IgG (10 nM) and increasing concentrations of EpCAM-CD28. Dots represent means of technical duplicates.

Figure 36A:
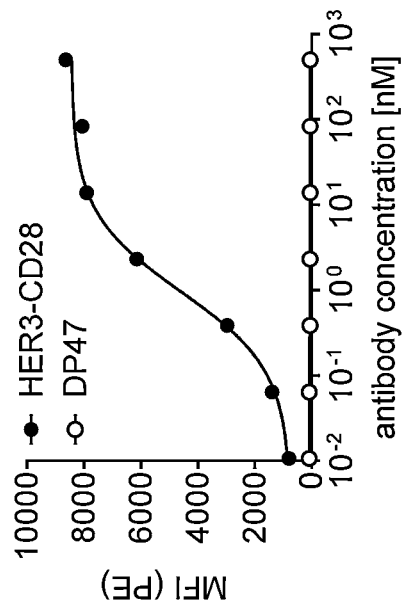
Figure 36B:
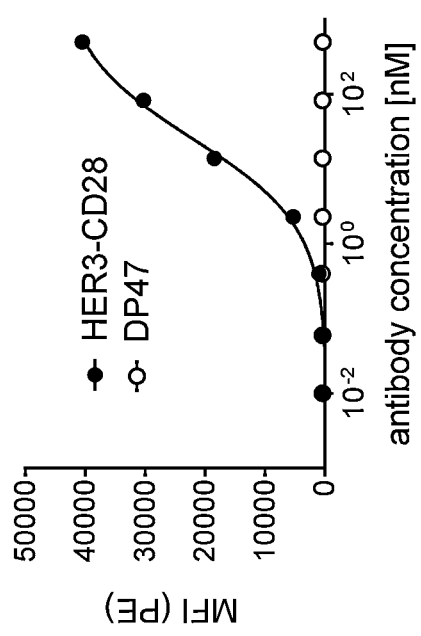
Figure 36C:
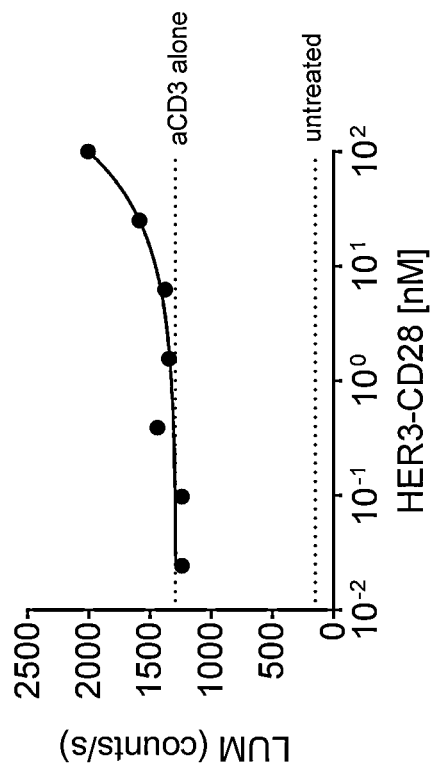

FIGS. 36A to 36C relate to the functional characterization of HER3-CD28 bispecific antigen binding molecules. In FIG. 36A it is shown that HER3-CD28 (P1AF0151) binds to human CD28 on CHO-kl cells expressing CD28, assessed by flow cytometry. The binding to of HER3-CD28 to HER3 on T-47D cells, assessed by flow cytometry, is shown in FIG. 36B. Anti-DP47 served as negative control for unspecific binding of antibody compounds to cells. Dots are means of technical duplicates. In FIG. 36C it is shown that HER3-CD28 (P1AF0151) enhances T cell responses to anti-CD3 stimulus in the IL-2 reporter assay. Shown is IL-2 reporter cell activation measured by luminescence readout after 6 hours of co-incubation with T-47D cells in presence of suboptimal concentrations of anti-CD3 IgG clone OKT3 (10 nM) and increasing concentrations of HER3-CD28. Dots represent means of technical duplicates.

Figure 37A:
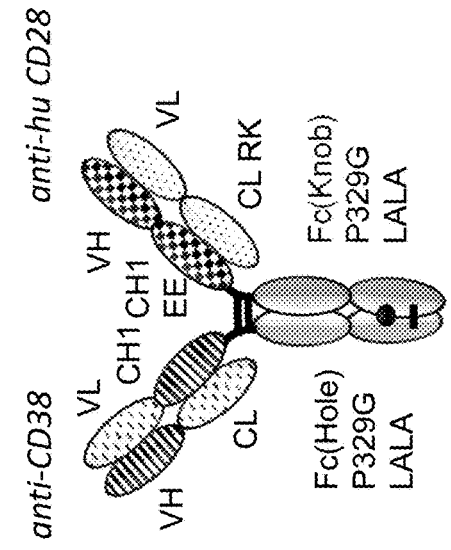
Figure 37B:
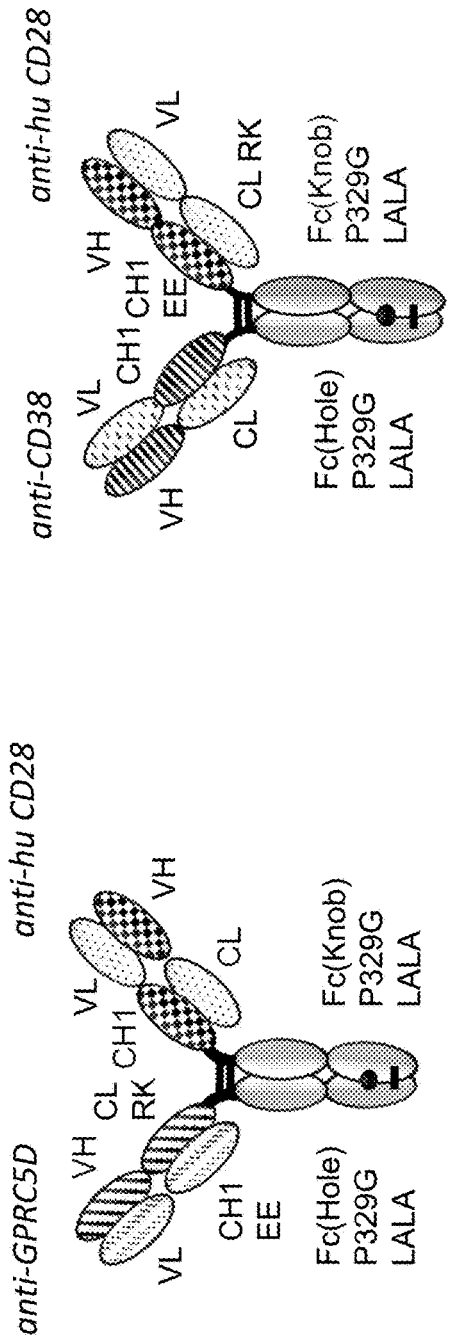
Figure 37D:
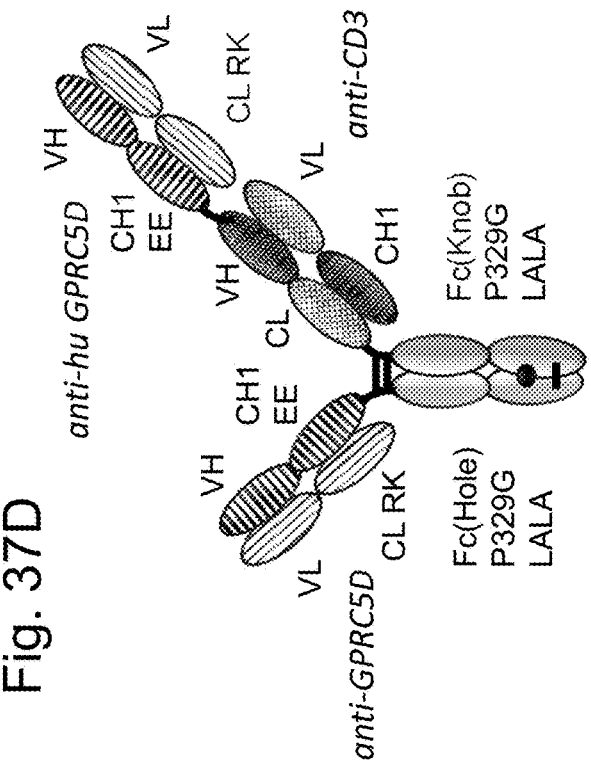
Figure 37C:
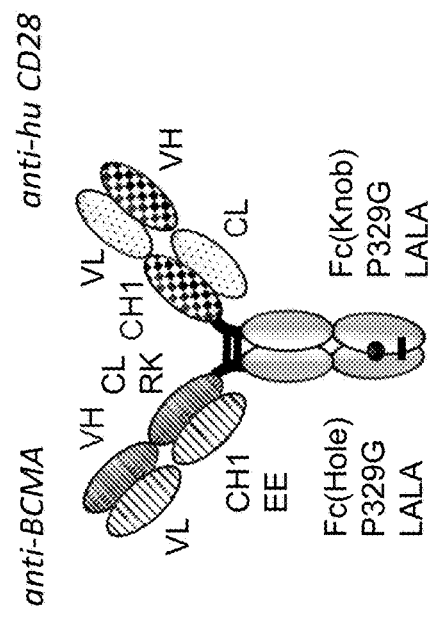
Figure 38A:
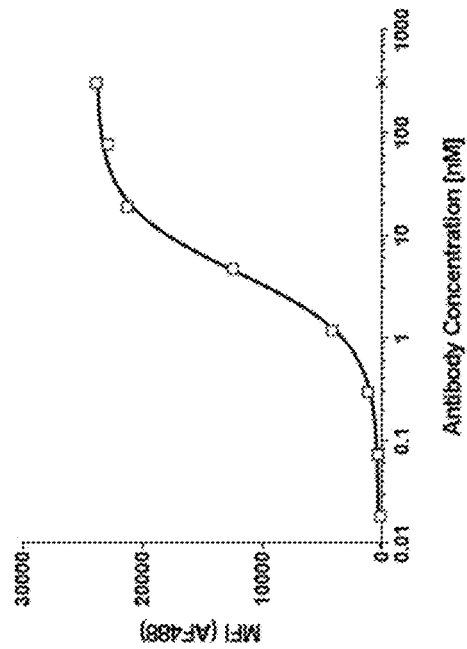
Figure 38B:
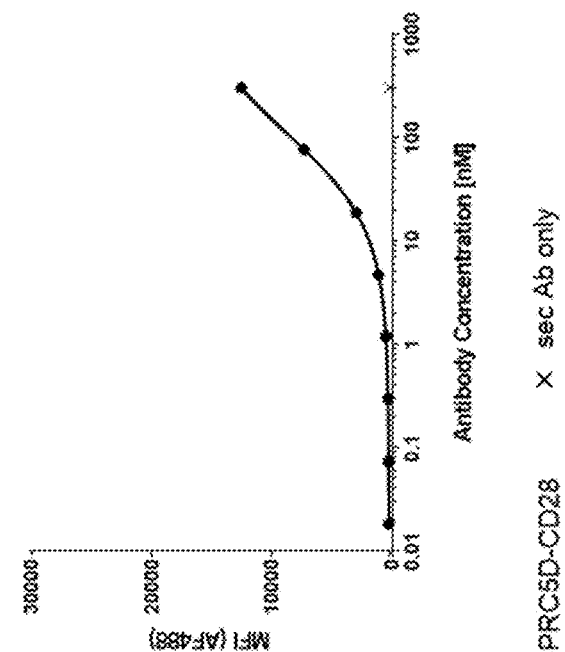
Figure 38C:
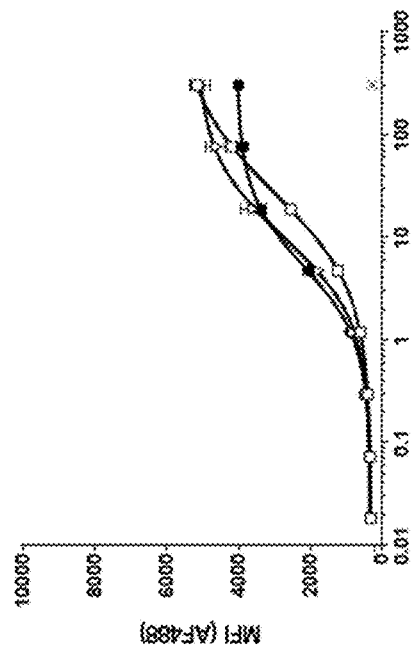
Figure 38D:
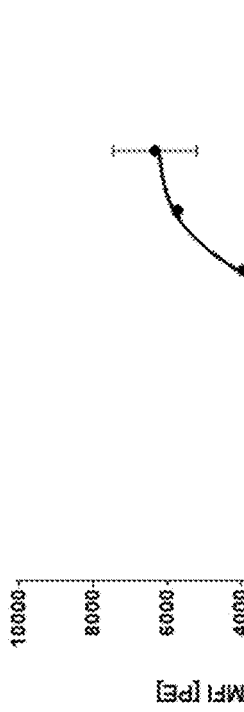

In FIGS. 37A to 37C schematic illustrations of bispecific CD28 antigen binding molecules targeting a Multiple Myeloma (MM) cell surface antigen as described in Example 16 are shown.

FIG. 37A shows a bispecific GPRC5D-CD28 antigen binding molecule in 1+1 format, wherein the CD28 antigen binding domain is represented as crossFab (VH/VL exchange) and in the Fab fragment bearing the CPRC5D antigen binding domain there are charged modifications in order to support the correct pairing of the light chains. The Fc domain has knob into hole modifications and the P329G LALA mutations to abrogate the binding to Fcγ receptors. In FIG. 37B the Fab bearing the CD28 antigen binding domain comprises charged modifications and the Fab bearing the CD38 antigen binding domain is represented as crossFab (VH/VL exchange).

FIG. 37C illustrates a bispecific BCMA-CD28 antigen binding molecule in 1+1 format, wherein Fab molecule bearing the CD28 antigen binding domain is represented as crossFab (VH/VL exchange) and the Fab bearing the BCMA antigen binding domain comprises charged modifications.

FIG. 37D illustrates the anti-GPRC5D/anti-CD3 bispecific antibody (GPRC5D TCB) in 2+1 format, wherein the Fab molecules bearing the GPCR5D antigen binding domain comprise charged modifications and the Fab bearing the CD3 antigen binding domain is represented as crossFab (VH/VL exchange).

FIGS. 38A to 38F relate to the binding of bispecific antigen binding molecules targeting CD28 and a Multiple Myeloma (MM) cell surface antigen to cells (Example 17.1). Shown is the binding of bispecific antigen binding molecules to either human CD28 on CHO huCD28 c145 cells (FIGS. 38A and 38E), to human CD38 on OCI-Ly18 cells (FIG. 38B), human BCMA (B-cell maturation antigen, FIG. 38C) on IM-9 cells and to human GPRC5D on CHO huGPRC5D L2 cells (FIGS. 38D and 38F) expressed on the indicated cell lines. Depicted are relative median fluorescence valus (MFI) from duplicates with SD. $EC_{50}$ values of binding were calculated by GraphPadPrism and are included in Table 38.

The T-cell activation of bispecific antigen binding molecules targeting CD28 and a Multiple Myeloma (MM) cell surface antigen as assessed in the IL-2 reporter assay is shown in FIGS. 39A to 39F. Shown is the IL2-reporter cell assay after 5 and 22 hours of incubation, as determined by luminescence. IL2-reporter effector and GPRC5D-expressing target cells were incubated at a effector to target ratio (E:T) of 5:1. GPRC5D-TCB was added at a fixed final assay concentration of 1 nM, the indicated MM-targeted CD28 bispecific antigen binding molecules were titrated as indicated. Representative dose-response curves are depicted for CD38-CD28 in FIG. 39A (after 5 hours of incubation) and FIG. 39B (after 22 hours), for BCMA-CD28 in FIG. 39C (after 5 hours) and FIG. 390 (after 22 hours) and for GPRC5D-CD28 in FIG. 39E (after 5 hours) and FIG. 39F (after 22 hours of incubation).

FIGS. 40A to 40C show the boosting of T-cell mediated lysis of the GPRC5D-expressing MM cell line NCI-H929 in presence of 0.2 nM of the indicated CD28 bispecific molecules CD38-CD28 (FIG. 40A), BCMA-CD28 (FIG. 40B) and GPRC5D-CD28 (FIG. 40C). Lysis was determined after co-incubation of human pan T-cells and MM tumor target cells at a final E:T ratio of 1:1 for 22 hours. Depicted are technical duplicates with SD. EC50 values and area under the curve values of tumor cell lysis were calculated by GraphPadPrism and are depicted in Table 39.

Figure 41A:
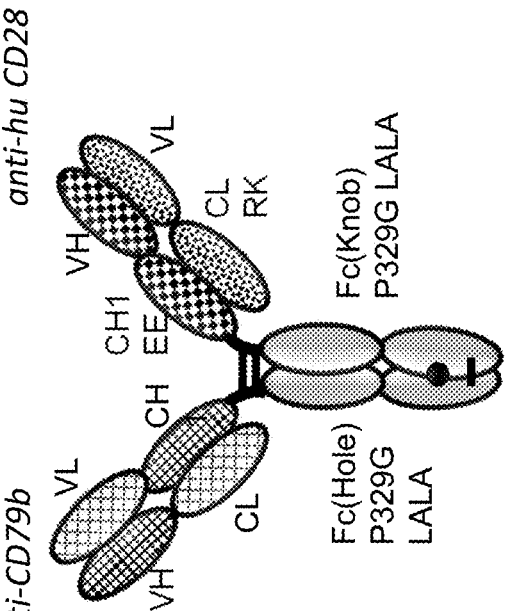
Figure 41B:
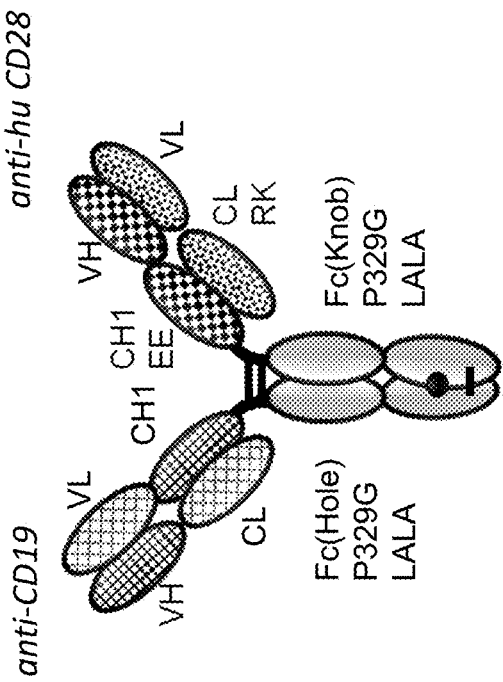

FIG. 41A shows a schematic illustration of a bispecific CD19-CD28 antigen binding molecule in 1+1 format as described in Example 18, wherein in the Fab comprising the CD19 antigen binding domain the VH and VL domains are exchanged with each other (VH/VL crossfab) and wherein in the Fab comprising the CD28 antigen binding domain certain amino acids in the CH1 and CL domain are exchanged (charge variants) to allow better pairing with the light chain. FIG. 41B shows a corresponding molecule wherein the CD19 antigen binding domain has been replaced by a CD79b antigen binding domain (anti-CD79b crossfab).

Figure 42:
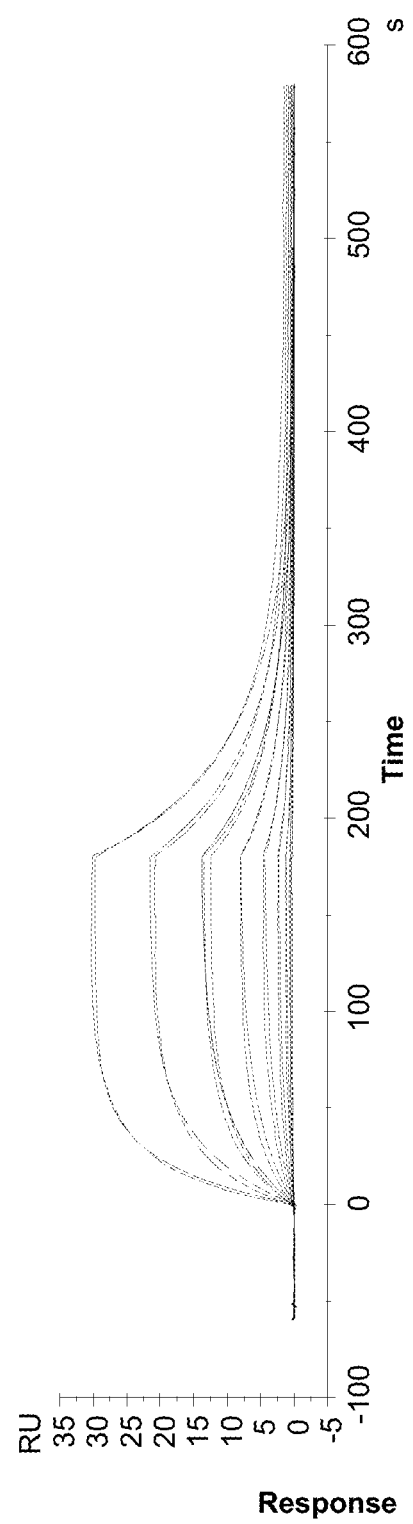

FIG. 42 relates to the determination of kinetic and thermodynamic parameters of CD79b (polatuzumab) in the construct CD79b (huMA79b.v28)-CD28 (v15) 1+1. Soluble recombinant CD79b-His was captured on CMS chip via an anti-penta-His antibody and bi-specific CD79b (huMA79b.v28)-CD28 (v15) 1+1 was used as an analyte. Smooth lines represent a global fit of the data to a 1:1 interaction mode.

Figure 43B:
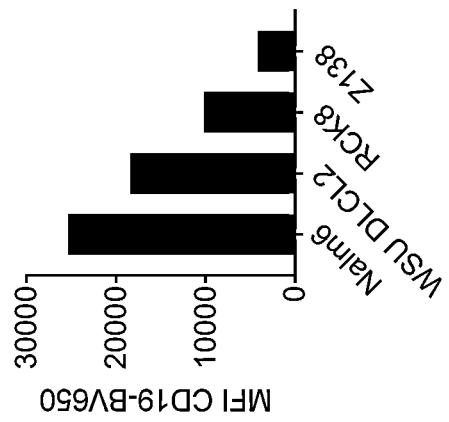
Figure 43A:
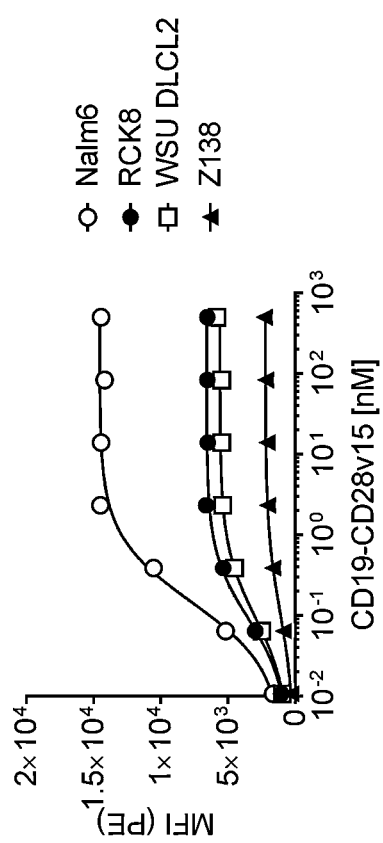

In FIG. 43A the median fluorescence intensities (MFI) of binding of CD19-CD28 variant 15 (P1AE9040) to four different B cell lines expressing different levels of CD19 are shown. Binding was assessed by flow cytometry. Shown are technical duplicates with SEM. In FIG. 43B FACS staining for CD19 of the four different B cell lines (MFI) is depicted.

Figure 44A:
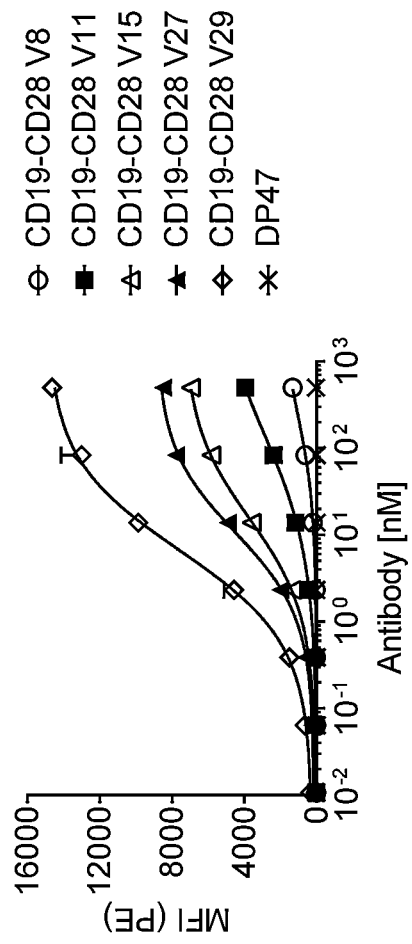
Figure 44B:
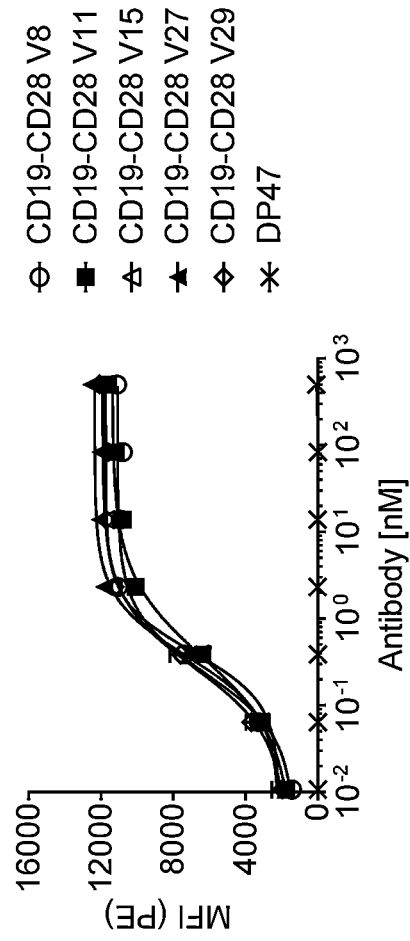
Figure 45B:
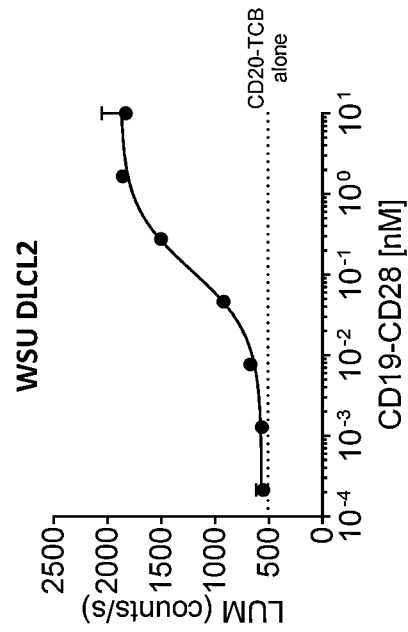
Figure 45D:
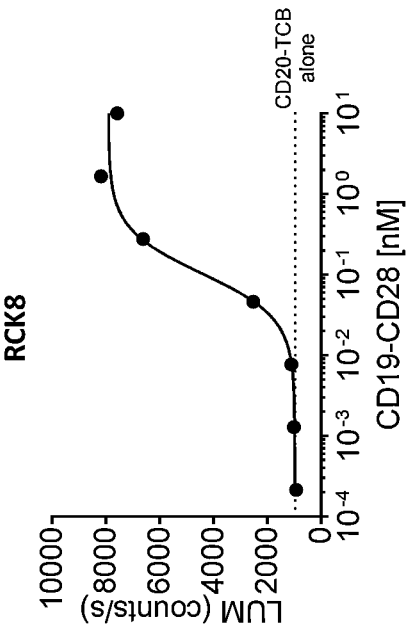
Figure 45A:
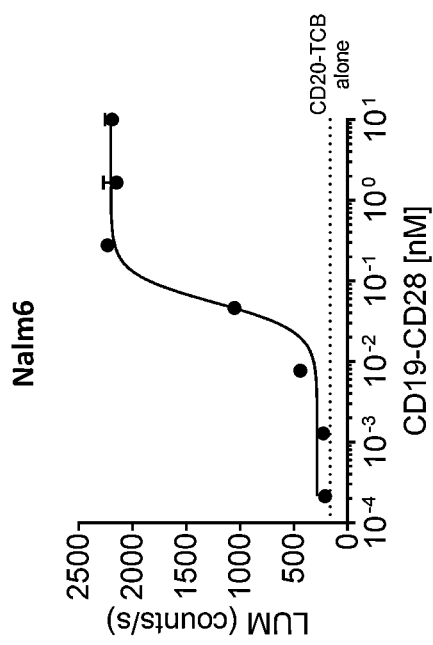
Figure 45C:
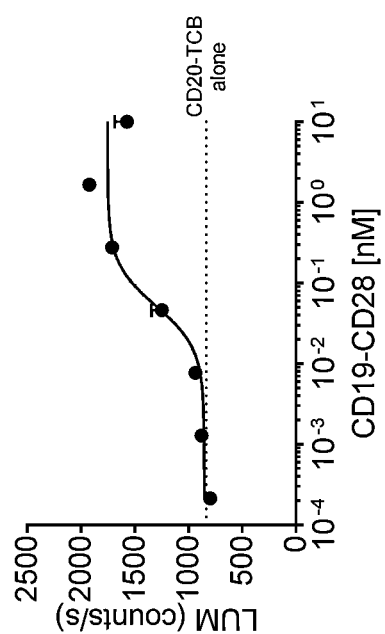

Binding of CD19-CD28 with varying CD28 affinities to human CD19 and CD28 on cells is shown in FIGS. 44A and 44B. Median fluorescence intensities (MFI) of binding to CHOk1-CD28 cells (FIG. 44A) and of binding to CD19 on Nalm6 B cells (FIG. 44B) are shown. Dots represent technical duplicates with SEM. Corresponding $EC_{50}$ values are shown in Table 42 (CHOk1-CD28) and Table 43 (Nalm6) of Example 20. Binding was assessed by flow cytometry.

In FIGS. 45A to 45D it is shown that CD19-CD28v15 enhances CD20-TCB in IL-2 reporter assay in presence of different B cell lines. Shown is 1L-2 reporter cell activation measured by luminescence readout (LUM) after 6 hours of co-incubation with different B cell lines in presence of suboptimal concentrations of CD20-TCB and increasing concentrations of CD19-CD28v15. Dots represent technical duplicates with SEM. Suboptimal CD20-TCB concentration differs with target cell lines: 10 nM for Nalm6, 0.05 nM for RCK8, WSU DLCL2 and Z138.

Figure 46:
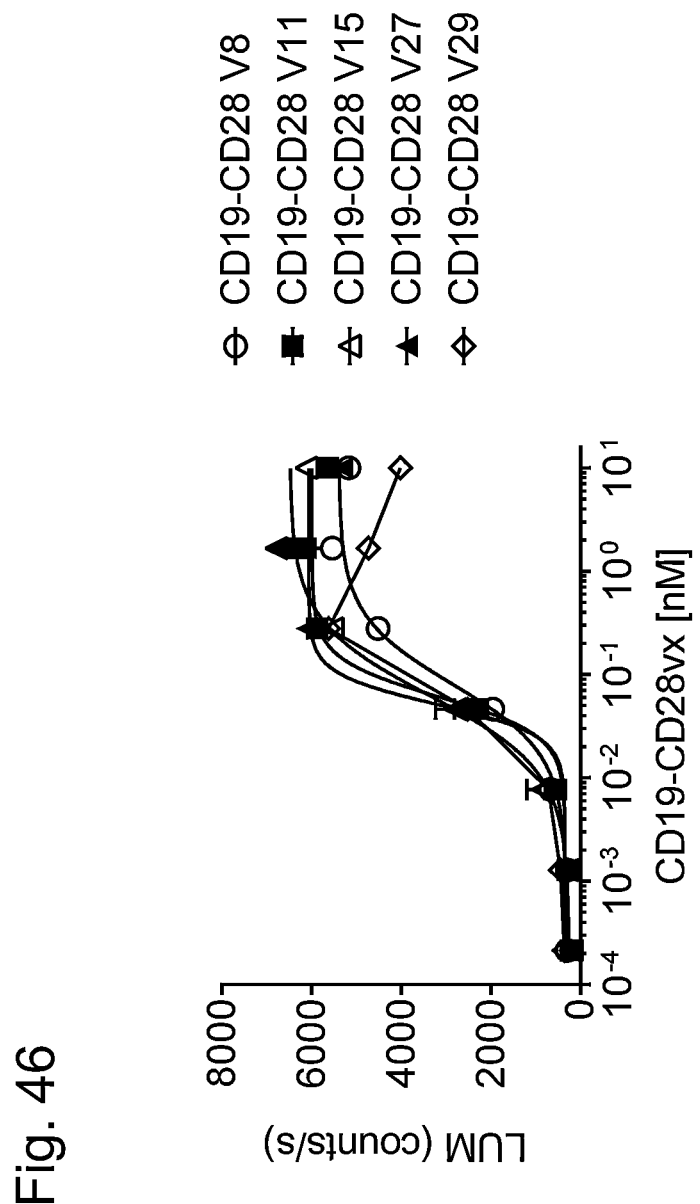

FIG. 46 illustrates that CD19-CD28 with various CD28 affinities enhances CD20-TCB mediated T cell activation. Shown is IL-2 reporter cell activation measured by luminescence readout (LUM) after 6 hours of co-incubation with Nalm6 B cells in presence of suboptimal concentrations of CD20-TCB (10 nM) and increasing concentrations of CD19-CD28v15. Dots represent technical duplicates with SEM.

Figure 47:
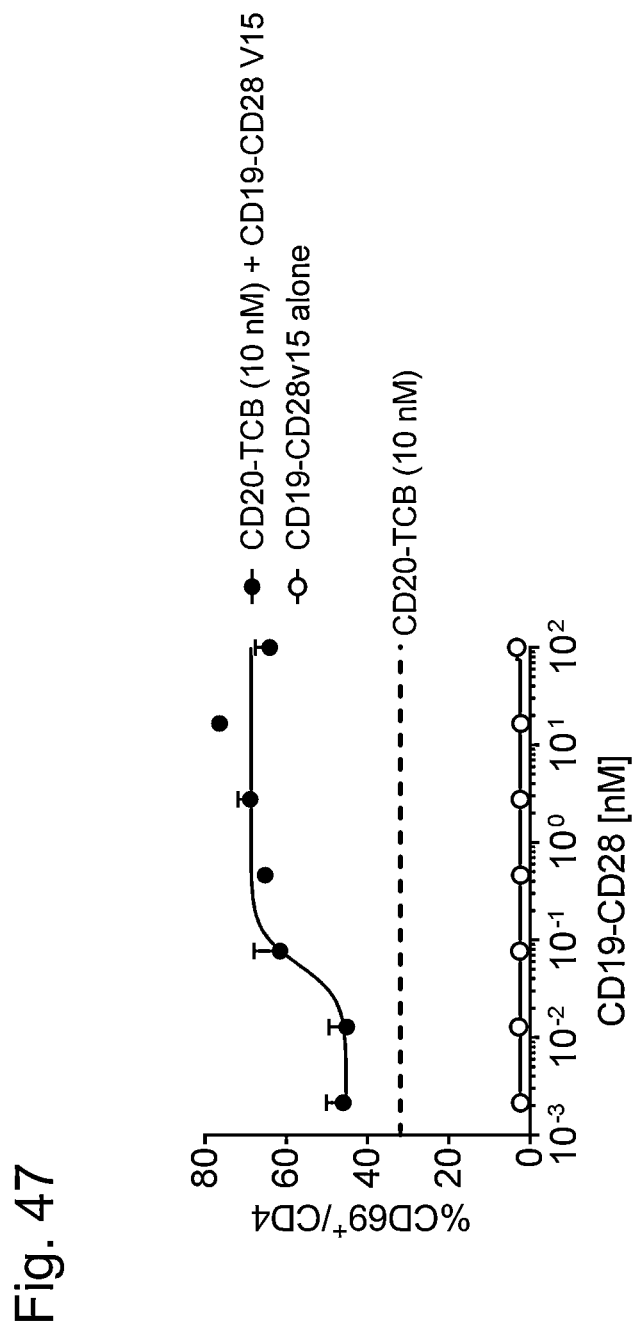

The activation status of PBMC-derived T cells after co-culture with CD20-expressing target cells (Nalm6) (E:T ratio 5:1) and CD19-CD28 in absence or presence of CD20-TCB was assessed. The activity of CD19-CD28 in absence or presence of TCR signals is shown in FIG. 47. Shown is CD69 expression of PBMC-derived CD4 T cells after 48 h of co-incubation with Nalm6 cells, increasing concentrations of CD19-CD28v15 in presence or absence of 10 nM CD20-TCB. Dots represent technical triplicates with SEM.

Figure 48B:
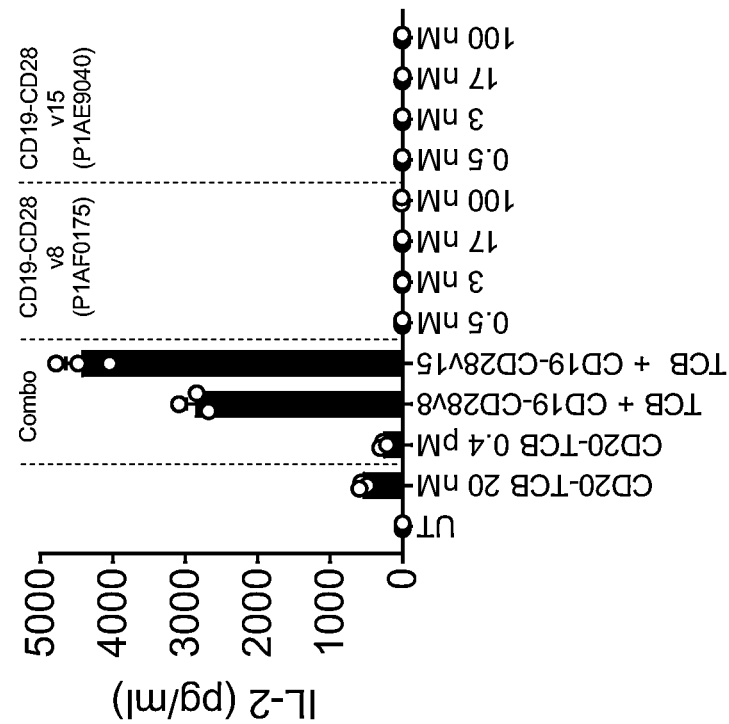
Figure 48A:
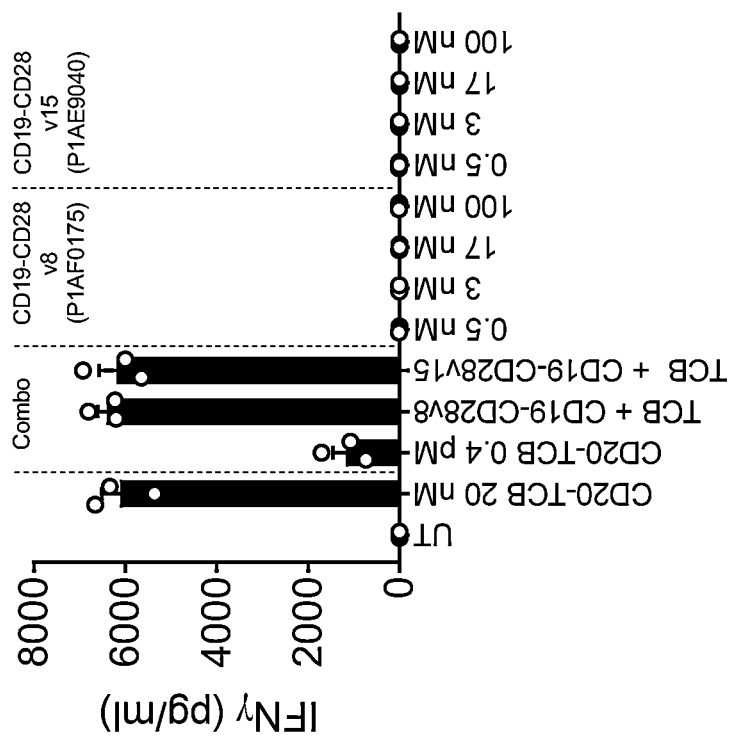
Figure 48D:
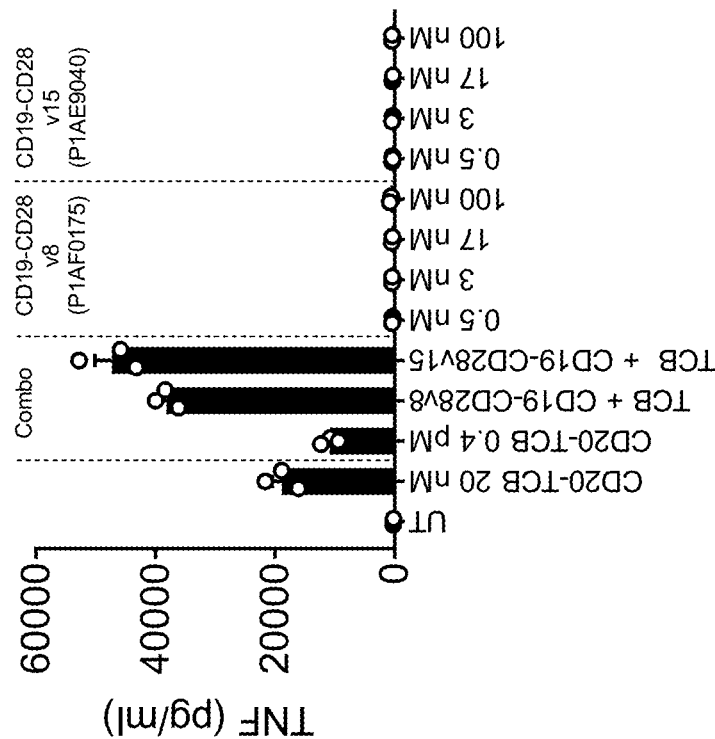
Figure 48C:
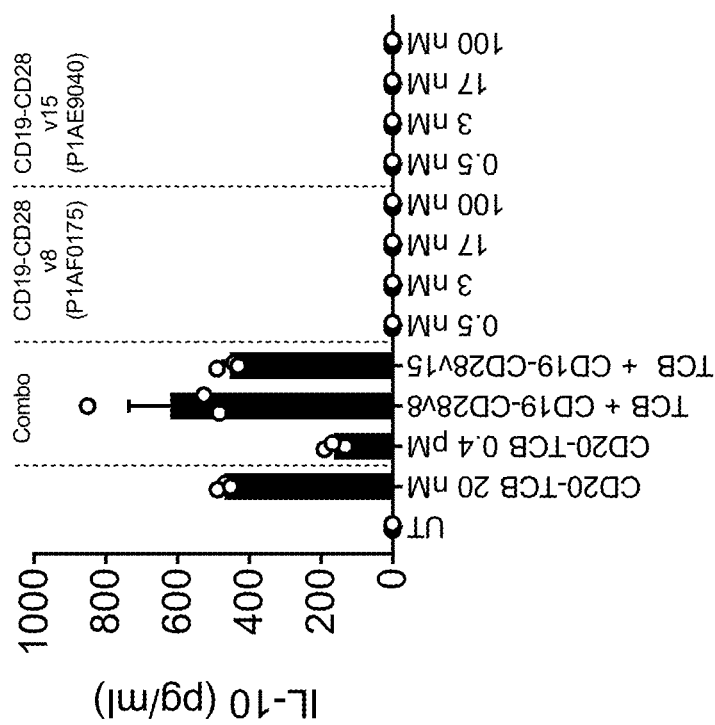

In FIGS. 48A to 48D it is illustrated that CD19-CD28 alone does not induce cytokine secretion in PBMCs. Shown is cytokine release in whole PBMCs after 48 hours of co-culture with CD19-CD28 molecules in presence or absence of CD20-TCB. Bars represent mean+SEM of technical triplicates. Data are representative of 2 donors. Cytokine secretion was assessed by Bio-Plex Pro Human Cytokine 17-plex Assay. Shown are IFNγ (FIG. 48A), IL-2 (FIG. 48B), IL-10 (FIG. 48C), and TNF (FIG. 48D).

Figure 49A:
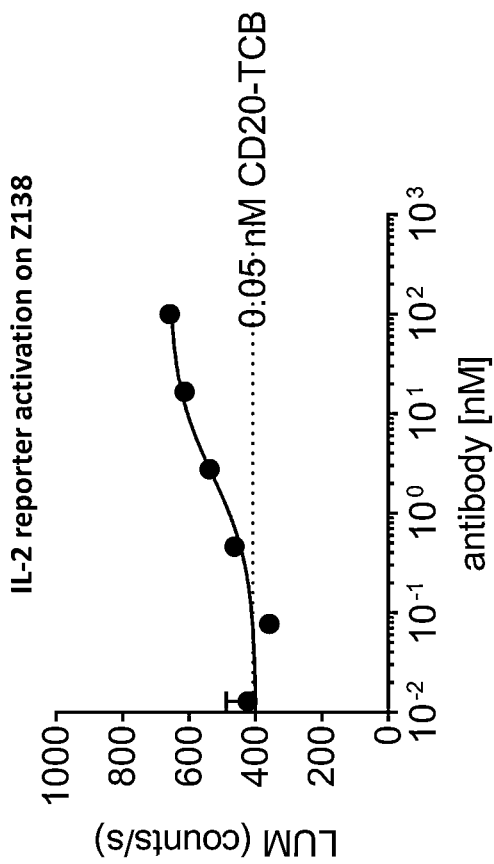
Figure 49B:
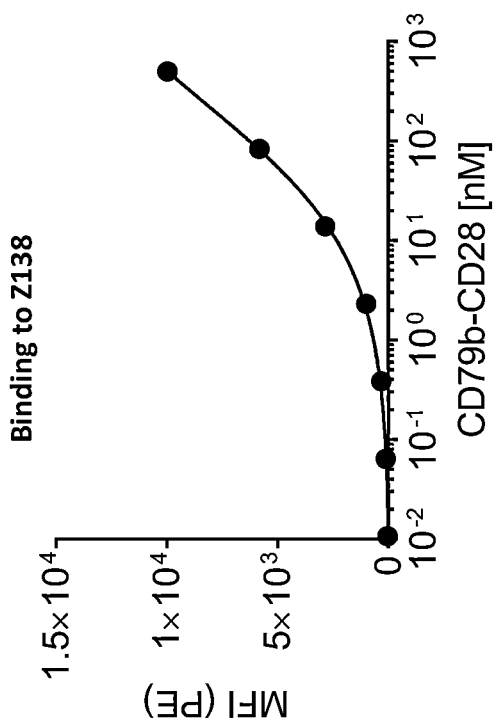

In FIGS. 49A and 49B, functional data relating to CD79b-CD28 are shown enhances CD20-TCB in IL-2 reporter assay in presence of Z138 B cells. In FIG. 49A, median fluorescence intensities (MFI) of binding to CD79b on Z138 B cells is shown. In FIG. 49B it is shown that CD79b-CD28 enhances CD20-TCB in IL-2 reporter assay in presence of Z138 B cells. Shown is IL-2 reporter cell activation measured by luminescence readout (LUM) after 6 hours of co-incubation with different B cell lines in presence of suboptimal concentrations of CD20-TCB and increasing concentrations of CD79b-CD28. Dots represent technical duplicates with SEM.

Figure 50:
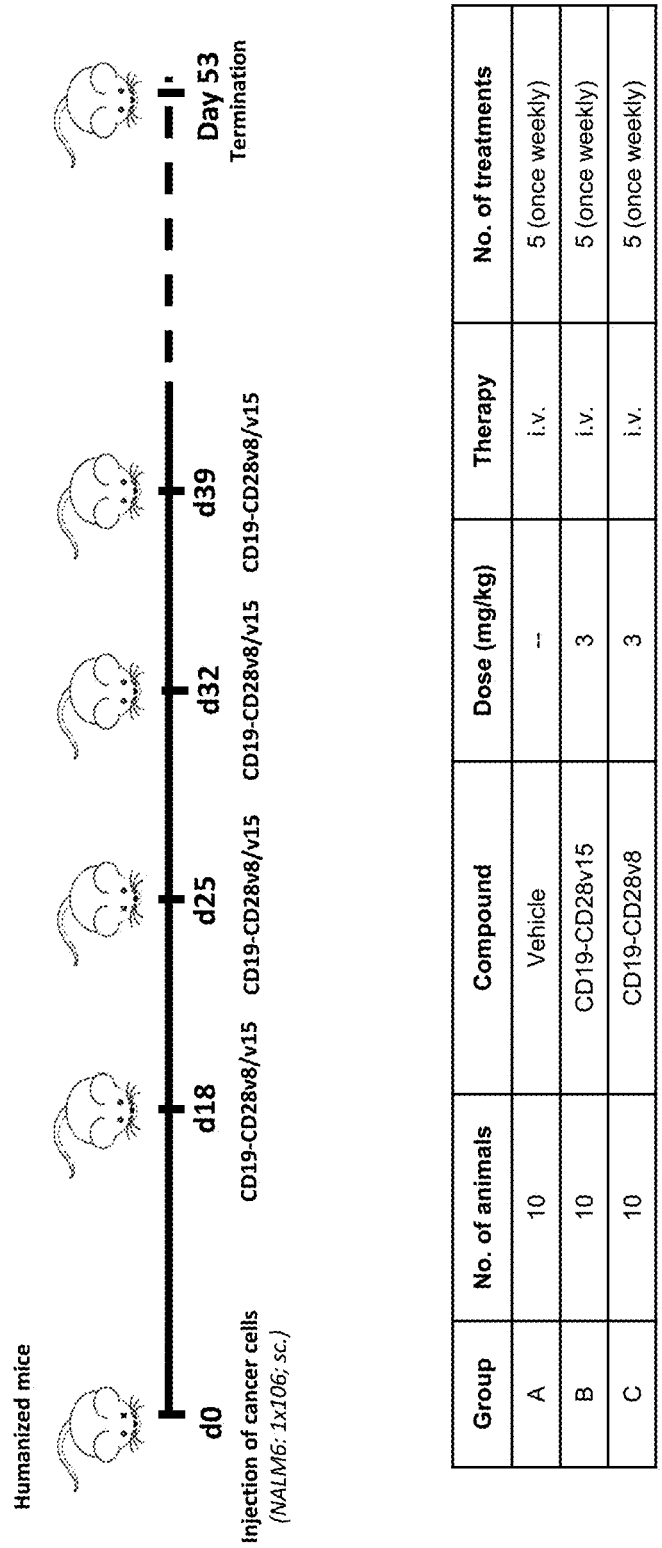

FIG. 50 shows the study design of an efficacy study with bispecific CD19-CD28 antibodies (comparison of two different CD28 clones) in NALM6 Xenograft in humanized mice. Shown is the design and the different treatment groups.

Figure 51A:
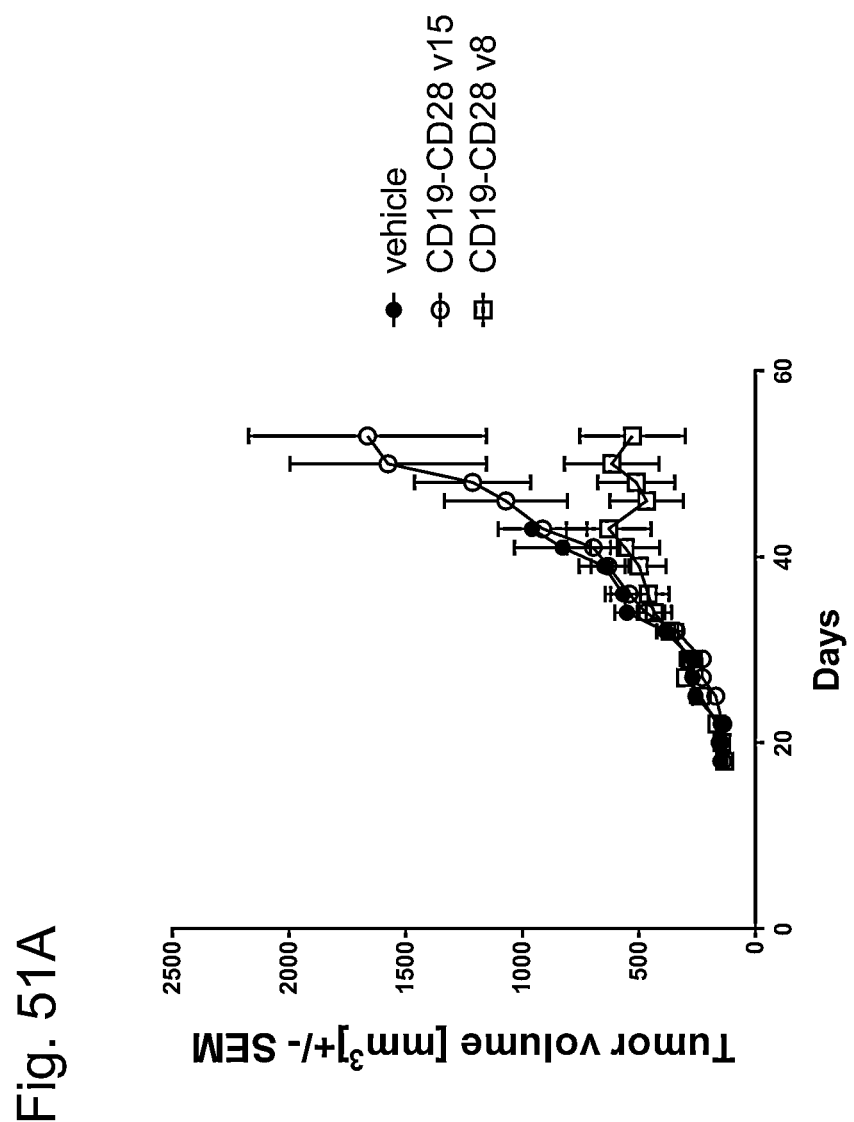
Figure 51C:
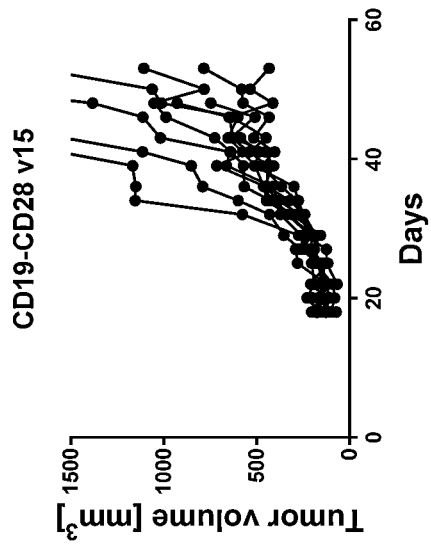
Figure 51D:
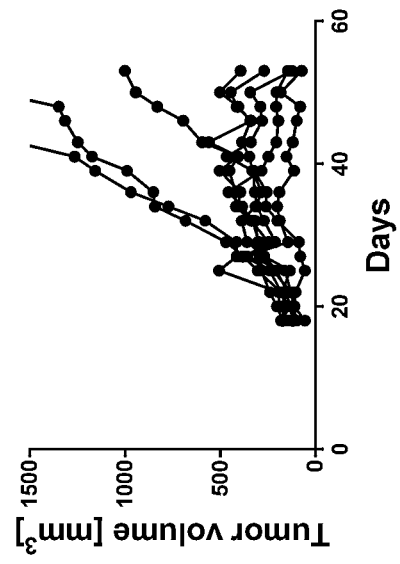
Figure 51B:
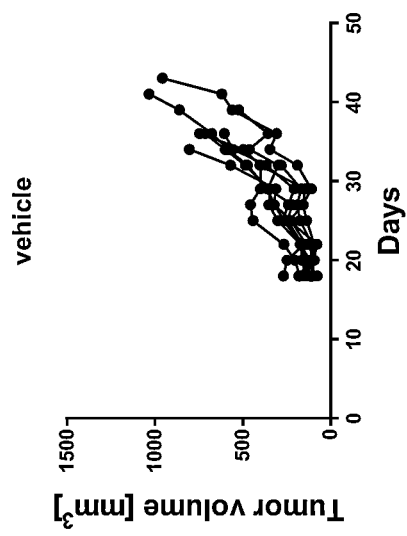

FIGS. 51A to 51D show results of the efficacy study with CD19-CD28 in NALM6 Xenograft in humanized mice. Shown is the average tumor volume (FIG. 51A) or the growth of tumors in individual mice for the three treatment groups as plotted on the y-axis (FIG. 51B to 51D). FIG. 51B shows the tumor growth for each individual mouse in the vehicle group, FIG. 51C of the mice treated with CD19-CD28 (variant 15) and FIG. 51D of mice treated with CD19-CD28 (variant 8). It can be seen that CD19-CD28 (variant 8) as a single agent induced stronger tumor growth inhibition as compared to CD19-CD28 (variant 15).

DETAILED DESCRIPTION OF THE INVENTION

Definitions

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, multispecific antibodies (e.g., bispecific antibodies), antibody fragments and scaffold antigen binding proteins.

As used herein, the term "antigen binding domain that binds to a tumor-associated antigen" or "moiety capable of specific binding to a tumor-associated antigen" refers to a polypeptide molecule that specifically binds to an antigenic determinant. In one aspect, the antigen binding domain is able to activate signaling through its target cell antigen. In a particular aspect, the antigen binding domain is able to direct the entity to which it is attached (e.g. the CD28 antibody) to a target site, for example to a specific type of tumor cell or tumor stroma bearing the antigenic determinant. Antigen binding domains capable of specific binding to a target cell antigen include antibodies and fragments thereof as further defined herein. In addition, antigen binding domains capable of specific binding to a target cell antigen include scaffold antigen binding proteins as further defined herein, e.g. binding domains which are based on designed repeat proteins or designed repeat domains (see e.g. WO 2002/020565).

In relation to an antigen binding molecule, i.e. an antibody or fragment thereof, the term "antigen binding domain that binds to a target cell antigen" refers to the part of the molecule that comprises the area which specifically binds to and is complementary to part or all of an antigen. An antigen binding domain capable of specific antigen binding may be provided, for example, by one or more antibody variable domains (also called antibody variable regions). Particularly, an antigen binding domain capable of specific antigen binding comprises an antibody light chain variable region (VL) and an antibody heavy chain variable region (VH). In another aspect, the "antigen binding domain capable of specific binding to a tumor-associated antigen" can also be a Fab fragment or a crossFab fragment. In another aspect, the "antigen binding domain capable of specific binding to a tumor-associated antigen" can also be a Fab fragment or a crossFab fragment. As used herein, the terms "first", "second" or "third" with respect to antigen binding domains etc., are used for convenience of distinguishing when there is more than one of each type of moiety. Use of these terms is not intended to confer a specific order or orientation of the moiety unless explicitly so stated.

As used herein, the term "antigen binding domain that binds to a B cell surface antigen" or "moiety capable of specific binding to a B cell surface antigen" refers to a polypeptide molecule that specifically binds to an antigenic determinant on the B cell surface. In one aspect, the antigen binding domain is able to activate signaling through its target cell antigen. In a particular aspect, the antigen binding domain is able to direct the entity to which it is attached (e.g. the CD28 agonist) to a target site, e.g. on the B cell. Antigen binding domains capable of specific binding to a B cell surface antigen include antibodies and fragments thereof as further defined herein. In addition, antigen binding domains capable of specific binding to a B cell surface antigen include scaffold antigen binding proteins as further defined herein, e.g. binding domains which are based on designed repeat proteins or designed repeat domains (see e.g. WO 2002/020565).

The term "antigen binding domain that binds to a Multiple Myeloma (MM) cell surface antigen" or "moiety capable of specific binding to a Multiple Myeloma (MM) cell surface antigen" refers to a polypeptide molecule that specifically binds to an antigenic determinant on Multiple Myeloma (MM) cell. In one aspect, the antigen binding domain is able to activate signaling through its target cell antigen. In a particular aspect, the antigen binding domain is able to direct the entity to which it is attached (e.g. the CD28 agonist) to a target site, e.g. on the MM cell. Antigen binding domains capable of specific binding to a Multiple Myeloma (MM) cell surface antigen include antibodies and fragments thereof as further defined herein. In addition, antigen binding domains capable of specific binding to a B cell surface antigen include scaffold antigen binding proteins as further defined herein, e.g. binding domains which are based on designed repeat proteins or designed repeat domains (see e.g. WO 2002/020565).

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies comprising the population are identical and/or bind the same epitope, except for possible variant antibodies, e.g. containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen.

The term "monospecific" antibody as used herein denotes an antibody that has one or more binding sites each of which bind to the same epitope of the same antigen. The term "bispecific" means that the antigen binding molecule is able to specifically bind to at least two distinct antigenic determinants. Typically, a bispecific antigen binding molecule comprises two antigen binding sites, each of which is specific for a different antigenic determinant. However, a bispecific antigen binding molecule may also comprise additional antigen binding sites which bind to further antigenic determinants. In certain aspects, the bispecific antigen binding molecule is capable of simultaneously binding two antigenic determinants, particularly two antigenic determinants expressed on two distinct cells or on the same cell. The term "bispecific" in accordance with the present invention thus may also include a trispecific molecule, e.g. a bispecific molecule comprising a CD28 antibody and two antigen binding domains directed to two different target cell antigens.

The term "valent" as used within the current application denotes the presence of a specified number of binding sites specific for one distinct antigenic determinant in an antigen binding molecule that are specific for one distinct antigenic determinant. As such, the terms "bivalent", "tetravalent", and "hexavalent" denote the presence of two binding sites, four binding sites, and six binding sites specific for a certain antigenic determinant, respectively, in an antigen binding molecule. In particular aspects of the invention, the bispecific antigen binding molecules according to the invention can be monovalent for a certain antigenic determinant, meaning that they have only one binding site for said antigenic determinant or they can be bivalent or tetravalent for a certain antigenic determinant, meaning that they have two binding sites or four binding sites, respectively, for said antigenic determinant.

The terms "full length antibody", "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies, triabodies, tetrabodies, crossFab fragments; linear antibodies; single-chain antibody molecules (e.g. scFv); and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046. Diabodies are antibody fragments with two antigen-binding sites that may be bivalent or bispecific, see, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see e.g. U.S. Pat. No. 6,248,516 B1). Antibody fragments can be made by various techniques, including but not limited to proteolytic digestion of an intact antibody as well as production by recombinant host cells (e.g. *E. coli* or phage), as described herein.

Papain digestion of intact antibodies produces two identical antigen-binding fragments, called "Fab" fragments containing each the heavy- and light-chain variable domains and also the constant domain of the light chain and the first constant domain (CH1) of the heavy chain. As used herein, Thus, the term "Fab fragment" refers to an antibody fragment comprising a light chain fragment comprising a variable light chain (VL) domain and a constant domain of a light chain (CL), and a variable heavy chain (VH) domain and a first constant domain (CH1) of a heavy chain. Fab' fragments differ from Fab fragments by the addition of a few residues at the carboxy terminus of the heavy chain CH1 domain including one or more cysteins from the antibody hinge region. Fab'-SH are Fab' fragments in which the cysteine residue(s) of the constant domains bear a free thiol group. Pepsin treatment yields an F(ab')2 fragment that has two antigen-combining sites (two Fab fragments) and a part of the Fc region.

The term "crossFab fragment" or "xFab fragment" or "crossover Fab fragment" refers to a Fab fragment, wherein either the variable regions or the constant regions of the heavy and light chain are exchanged. Two different chain compositions of a crossover Fab molecule are possible and comprised in the bispecific antibodies of the invention: On the one hand, the variable regions of the Fab heavy and light chain are exchanged, i.e. the crossover Fab molecule comprises a peptide chain composed of the light chain variable (VL) domain and the heavy chain constant domain (CHI), and a peptide chain composed of the heavy chain variable domain (VH) and the light chain constant domain (CL). This crossover Fab molecule is also referred to as CrossFab$_{(VLVH)}$. On the other hand, when the constant regions of the Fab heavy and light chain are exchanged, the crossover Fab molecule comprises a peptide chain composed of the heavy chain variable domain (VH) and the light chain constant domain (CL), and a peptide chain composed of the light chain variable domain (VL) and the heavy chain constant domain (CH1). This crossover Fab molecule is also referred to as CrossFab$_{(CLCH1)}$.

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy ($V_H$) and light chains ($V_L$) of an antibody, connected with a short linker peptide of ten to about 25 amino acids. The linker is usually rich in glycine for flexibility, as well as serine or threonine for solubility, and can either connect the N-terminus of the $V_H$ with the C-terminus of the $V_L$, or vice versa. This protein retains the specificity of the original antibody, despite removal of the constant regions and the introduction of the linker. scFv antibodies are, e.g. described in Houston, J. S., Methods in Enzymol. 203 (1991) 46-96). In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

"Scaffold antigen binding proteins" are known in the art, for example, fibronectin and designed ankyrin repeat proteins (DARPins) have been used as alternative scaffolds for antigen-binding domains, see, e.g., Gebauer and Skerra, Engineered protein scaffolds as next-generation antibody therapeutics. Curr Opin Chem Biol 13:245-255 (2009) and Stumpp et al., Darpins: A new generation of protein therapeutics. Drug Discovery Today 13: 695-701 (2008). In one aspect of the invention, a scaffold antigen binding protein is selected from the group consisting of CTLA-4 (Evibody), Lipocalins (Anticalin), a Protein A-derived molecule such as Z-domain of Protein A (Affibody), an A-domain (Avimer/Maxibody), a serum transferrin (trans-body); a designed ankyrin repeat protein (DARPin), a variable domain of antibody light chain or heavy chain (single-domain antibody, sdAb), a variable domain of antibody heavy chain (nanobody, aVH), $V_{NAR}$ fragments, a fibronectin (AdNectin), a C-type lectin domain (Tetranectin); a variable domain of a new antigen receptor beta-lactamase ($V_{NAR}$ fragments), a human gamma-crystallin or ubiquitin (Affilin molecules); a kunitz type domain of human protease inhibitors, microbodies such as the proteins from the knottin family, peptide aptamers and fibronectin (adnectin). CTLA-4 (Cytotoxic T Lymphocyte-associated Antigen 4) is a CD28-family receptor expressed on mainly CD4$^+$ T-cells. Its extracellular domain has a variable domain-like Ig fold. Loops corresponding to CDRs of antibodies can be substituted with heterologous sequence to confer different binding properties. CTLA-4 molecules engineered to have different binding specificities are also known as Evibodies (e.g. U.S. Pat. No. 7,166,697B1). Evibodies are around the same size as the isolated variable region of an antibody (e.g. a domain antibody). For further details, see Journal of Immunological Methods 248 (1-2), 31-45 (2001). Lipocalins are a family of extracellular proteins which transport small hydrophobic molecules such as steroids, bilins, retinoids and lipids. They have a rigid beta-sheet secondary structure with a number of loops at the open end of the conical structure which can be engineered to bind to different target antigens. Anticalins are between 160-180 amino acids in size, and are derived from lipocalins. For further details, see Biochim Biophys Acta 1482: 337-350 (2000), U.S. Pat. No. 7,250,297B1 and US20070224633. An affibody is a scaffold derived from Protein A of *Staphylococcus aureus* which can be engineered to bind to antigen. The domain consists of a three-helical bundle of approximately 58 amino acids. Libraries have been generated by randomization of surface residues. For further details, see Protein Eng. Des. Sel. 2004, 17, 455-462 and EP 1641818A1. Avimers are multidomain proteins derived from the A-domain scaffold family. The native domains of approximately 35 amino acids adopt a defined disulfide bonded structure. Diversity is generated by shuffling of the natural variation exhibited by the family of A-domains. For further details, see Nature Biotechnology 23(12), 1556-1561 (2005) and Expert Opinion on Investigational Drugs 16(6), 909-917 (June 2007). A transferrin is a monomeric serum transport glycoprotein. Transferrins can be engineered to bind different target antigens by insertion of peptide sequences in a permissive surface loop. Examples of engineered transferrin scaffolds include the Trans-body. For further details, see J. Biol. Chem 274, 24066-24073 (1999). Designed Ankyrin Repeat Proteins (DARPins) are derived from Ankyrin which is a family of proteins that mediate attachment of integral membrane proteins to the cytoskeleton. A single ankyrin repeat is a 33 residue motif consisting of two alpha-helices and a beta-turn. They can be engineered to bind different target antigens by randomizing residues in the first alpha-helix and a beta-turn of each repeat. Their binding interface can be increased by increasing the number of modules (a method of affinity maturation). For further details, see J. Mol. Biol. 332, 489-503 (2003), PNAS 100(4), 1700-1705 (2003) and J. Mol. Biol. 369, 1015-1028 (2007) and US20040132028A1. A single-domain antibody is an antibody fragment consisting of a single monomeric variable antibody domain. The first single domains were derived from the variable domain of the antibody heavy chain from camelids (nanobodies or $V_HH$ fragments). Furthermore, the term single-domain antibody includes an autonomous human heavy chain variable domain (aVH) or $V_{NAR}$ fragments derived from sharks. Fibronectin is a scaffold which can be engineered to bind to antigen. Adnectins consists of a backbone of the natural amino acid sequence of the 10th domain of the 15 repeating units of human fibronectin type III (FN3). Three loops at one end of the beta-sandwich can be engineered to enable an Adnectin to specifically recognize a therapeutic target of interest. For further details, see Protein Eng. Des. Sel. 18, 435-444 (2005), US20080139791, WO2005056764 and U.S. Pat. No. 6,818,418B1. Peptide aptamers are combinatorial recognition molecules that consist of a constant scaffold protein, typically thioredoxin (TrxA) which contains a constrained variable peptide loop inserted at the active site. For further details, see Expert Opin. Biol. Ther. 5, 783-797 (2005). Microbodies are derived from naturally occurring microproteins of 25-50 amino acids in length which contain 3-4 cysteine bridges—examples of microproteins include KalataBl and conotoxin and knottins. The microproteins have a loop which can be engineered to include up to 25 amino acids without affecting the overall fold of the microprotein. For further details of engineered knottin domains, see WO2008098796.

An "antigen binding molecule that binds to the same epitope" as a reference molecule refers to an antigen binding molecule that blocks binding of the reference molecule to its antigen in a competition assay by 50% or more, and conversely, the reference molecule blocks binding of the antigen binding molecule to its antigen in a competition assay by 50% or more.

The term "antigen binding domain" refers to the part of an antigen binding molecule that comprises the area which specifically binds to and is complementary to part or all of an antigen. Where an antigen is large, an antigen binding molecule may only bind to a particular part of the antigen, which part is termed an epitope. An antigen binding domain may be provided by, for example, one or more variable domains (also called variable regions). Preferably, an antigen binding domain comprises an antibody light chain variable domain (VL) and an antibody heavy chain variable domain (VH).

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins useful as antigens herein can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants.

By "specific binding" is meant that the binding is selective for the antigen and can be discriminated from unwanted or non-specific interactions. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIAcore instrument) (Liljeblad et al., Glyco J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant (Kd) of ≤1 µM, ≤100 nM, ≤10 nM, ≤1 nM, ≤0.1 nM, ≤0.01 nM, or 0.001 nM (e.g. $10^{-8}$M or less, e.g. from $10^{-8}$ M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein, "binding affinity" refers to intrinsic binding affinity which reflects a 1:1 interaction between members of a binding pair (e.g. antibody and antigen). The affinity of a molecule X for its partner Y can generally be represented by the dissociation constant (Kd), which is the ratio of dissociation and association rate constants (koff and kon, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

A "tumor-associated antigen" or TAA as used herein refers to an antigenic determinant presented on the surface of a target cell, for example a cell in a tumor such as a cancer cell, a cell of the tumor stroma, a malignant B lymphocyte or a melanoma cell. In certain aspects, the target cell antigen is an antigen on the surface of a tumor cell. In one aspect, TAA is selected from the group consisting of Fibroblast Activation Protein (FAP), Carcinoembryonic Antigen (CEA), Folate receptor alpha (FolR1), Melanoma-associated Chondroitin Sulfate Proteoglycan (MCSP), Epidermal Growth Factor Receptor (EGFR), human epidermal growth factor receptor 2 (HER2), p95HER2, EpCAM, HER3, CD30 or TPBG (5T4), CD19, CD79b, CD20, CD22, CD37, CD38, BCMA and GPRC5D. In one particular aspect, TAA is selected from the group consisting of Fibroblast Activation Protein (FAP), Carcinoembryonic Antigen (CEA), Folate receptor alpha (FolR1), Melanoma-associated Chondroitin Sulfate Proteoglycan (MCSP), Epidermal Growth Factor Receptor (EGFR), human epidermal growth factor receptor 2 (HER2) and p95HER2. In another particular aspect, TAA is selected from the group consisting of Fibroblast Activation Protein (FAP), Carcinoembryonic Antigen (CEA), EpCAM, HER3, CD30 or TPBG (5T4). In one particular aspect, the tumor-associated antigen is Fibroblast Activation Protein (FAP) or Carcinoembryonic Antigen (CEA). In one aspect, TAA is a B cell surface antigen selected from the group consisting of CD19, CD79b, CD20, CD22 and CD37, in particular CD19 and CD79b. In one aspect, TAA is a Multiple Myeloma (MM) cell surface antigen selected from the group consisting of CD38, BCMA and GPRC5D.

The term "Fibroblast activation protein (FAP)", also known as Prolyl endopeptidase FAP or Seprase (EC 3.4.21), refers to any native FAP from any vertebrate source, including mammals such as primates (e.g. humans) non-human primates (e.g. cynomolgus monkeys) and rodents (e.g. mice and rats), unless otherwise indicated. The term encompasses "full-length," unprocessed FAP as well as any form of FAP that results from processing in the cell. The term also encompasses naturally occurring variants of FAP, e.g., splice variants or allelic variants. In one embodiment, the antigen binding molecule of the invention is capable of specific binding to human, mouse and/or cynomolgus FAP. The amino acid sequence of human FAP is shown in UniProt (world wide web.uniprot.org) accession no. Q12884 (version 149, SEQ ID NO:2), or NCBI (world wide web.ncbi.nlm.nih.gov/) RefSeq NP_004451.2. The extracellular domain (ECD) of human FAP extends from amino acid position 26 to 760. The amino acid sequence of a His-tagged human FAP ECD is shown in SEQ ID NO:135. The amino acid sequence of mouse FAP is shown in UniProt accession no. P97321 (version 126, SEQ ID NO:136), or NCBI RefSeq NP_032012.1. The extracellular domain (ECD) of mouse FAP extends from amino acid position 26 to 761. SEQ ID NO:137 shows the amino acid sequence of a His-tagged mouse FAP ECD. SEQ ID NO 138 shows the amino acid sequence, of a His-tagged cynomolgus FAP ECD. Preferably, an anti-FAP binding molecule of the invention binds to the extracellular domain of FAP.

The term "Carcinoembroynic antigen (CEA)", also known as Carcinoembryonic antigen-related cell adhesion molecule 5 (CEACAM5), refers to any native CEA from any vertebrate source, including mammals such as primates (e.g. humans) non-human primates (e.g. cynomolgus monkeys) and rodents (e.g. mice and rats), unless otherwise indicated. The amino acid sequence of human CEA is shown in UniProt accession no. P06731 (version 151, SEQ ID NO:3). CEA has long been identified as a tumor-associated antigen (Gold and Freedman, J Exp Med., 121:439-462, 1965; Berinstein N. L., J Clin Oncol., 20:2197-2207, 2002). Originally classified as a protein expressed only in fetal tissue, CEA has now been identified in several normal adult tissues. These tissues are primarily epithelial in origin, including cells of the gastrointestinal, respiratory, and urogential tracts, and cells of colon, cervix, sweat glands, and prostate (Nap et al., Tumour Biol., 9(2-3):145-53, 1988; Nap et al., Cancer Res., 52(8):2329-23339, 1992). Tumors of epithelial origin, as well as their metastases, contain CEA as a tumor associated antigen. While the presence of CEA itself does not indicate transformation to a cancerous cell, the distribution of CEA is indicative. In normal tissue, CEA is generally expressed on the apical surface of the cell (Hammarström S., Semin Cancer Biol. 9(2):67-81 (1999)), making it inaccessible to antibody in the blood stream. In contrast to normal tissue, CEA tends to be expressed over the entire surface of cancerous cells (Hammarström S., Semin Cancer Biol. 9(2):67-81 (1999)). This change of expression pattern makes CEA accessible to antibody binding in cancerous cells. In addition, CEA expression increases in cancerous cells. Furthermore, increased CEA expression promotes increased intercellular adhesions, which may lead to metastasis (Marshall J., Semin Oncol., 30(a Suppl. 8):30-6, 2003). The prevalence of CEA expression in various tumor entities is generally very high. In concordance with published data, own analyses performed in tissue samples confirmed its high prevalence, with approximately 95% in colorectal carcinoma (CRC), 90% in pancreatic cancer, 80% in gastric cancer, 60% in non-small cell lung cancer (NSCLC, where it is co-expressed with HER3), and 40% in breast cancer; low expression was found in small cell lung cancer and glioblastoma.

CEA is readily cleaved from the cell surface and shed into the blood stream from tumors, either directly or via the lymphatics. Because of this property, the level of serum CEA has been used as a clinical marker for diagnosis of cancers and screening for recurrence of cancers, particularly colorectal cancer (Goldenberg D M., The International Journal of Biological Markers, 7:183-188, 1992; Chau I., et al., J Clin Oncol., 22:1420-1429, 2004; Flamini et al., Clin Cancer Res; 12(23):6985-6988, 2006).

The term "epithelial cell adhesion molecule (EpCAM)" refers to any native EpCAM from any vertebrate source, including mammals such as primates (e.g. humans) non-human primates (e.g. cynomolgus monkeys) and rodents (e.g. mice and rats), unless otherwise indicated. The term encompasses "full-length," unprocessed EpCAM as well as any form of EpCAM that results from processing in the cell. The term also encompasses naturally occurring variants of EpCAM, e.g., splice variants or allelic variants. In one embodiment, the antigen binding molecule of the invention is capable of specific binding to human, mouse and/or cynomolgus EpCAM. The amino acid sequence of human EpCAM is shown in UniProt (world wide web.uniprot.org) accession no. P16422 (version 167, SEQ ID NO:68), or NCBI (world wide web.ncbi.nlm.nih.gov/) RefSeq NP_002345.2. The amino acid sequence of mouse EpCAM is shown in UniProt (world wide web.uniprot.org) accession no. Q99JW5 (version 111, SEQ ID NO:75), or NCBI (world wide web.ncbi.nlm.nih.gov/) RefSeq NP_032558.2. Epithelial cell adhesion molecule (EpCAM)—also known as tumor-associated calcium signal transducer 1 (TACSTD1), 17-1A and CD326—is a type I ~40 kDa transmembrane glycoprotein that is frequently overexpressed in cancers of epithelial origin and by cancer stem cells, and is therefore a molecule of significant interest for therapy and diagnosis. The extracellular domain EpCAM can be cleaved to yield the soluble extracellular domain molecule EpEX, and the intracellular molecule EpICD. EpICD has been shown to associate with other proteins to form a nuclear complex which upregulates the expression of genes promoting cell proliferation. EpCAM may also be involved in the epithelial to mesenchymal cell transition (EMT), and may contribute to the formation of large metastases.

"CD30" or "TNFRSF8" is a member of the tumor necrosis factor receptor superfamily. It is characteristically expressed in certain hematopoietic malignancies, including anaplastic large cell lymphoma and Hodgkin lymphoma, among others. The variable expression of CD30 on both normal and malignant lymphoid cells has focused research efforts on understanding the pathogenesis of CD30 upregulation, its contribution to lymphomagenesis through anti-apoptotic mechanisms, and its effect on cell survival. Given the restriction of CD30 to certain tumor types, the logical extension of this has been to attempt to exploit it as a therapeutic target. The CD30 is a 120 kD transmembrane glycoprotein receptor belonging to the tumor necrosis factor receptor (TNFR) superfamily, with intracellular, trans-membrane and extracellular domains and the amino acid sequence of human CD30 is shown in UniProt accession no. P28908 (SEQ ID NO:472).

The term "TPBG" refers to Trophoblast glycoprotein, also referred to as "5T4". TBPG is a leucine-rich transmembrane glycoprotein involved in cell adhesion. In adults this protein is highly expressed in many tumor cells and is associated with poor clinical outcome in numerous cancers. It refers to any native TPBG from any vertebrate source, including mammals such as primates (e.g. humans) non-human primates (e.g. cynomolgus monkeys) and rodents (e.g. mice and rats), unless otherwise indicated. The amino acid sequence of human TPBG is shown in UniProt accession no. Q13641 (SEQ ID NO: 473).

The term "FolR1" refers to Folate receptor alpha and has been identified as a potential prognostic and therapeutic target in a number of cancers. It refers to any native FolR1 from any vertebrate source, including mammals such as primates (e.g. humans) non-human primates (e.g. cynomolgus monkeys) and rodents (e.g. mice and rats), unless otherwise indicated. The amino acid sequence of human FolR1 is shown in UniProt accession no. P15328 (SEQ ID NO: 139), murine FolR1 has the amino acid sequence of UniProt accession no. P35846 (SEQ ID NO:140) and cynomolgus FolR1 has the amino acid sequence as shown in UniProt accession no. G7PR14 (SEQ ID NO:141). FolR1 is an N-glycosylated protein expressed on plasma membrane of cells. Foal has a high affinity for folic acid and for several reduced folic acid derivatives and mediates delivery of the physiological folate, 5-methyltetrahydrofolate, to the interior of cells. FOLR1 is a desirable target for FOLR1-directed cancer therapy as it is overexpressed in vast majority of ovarian cancers, as well as in many uterine, endometrial, pancreatic, renal, lung, and breast cancers, while the expression of FOLR1 on normal tissues is restricted to the apical membrane of epithelial cells in the kidney proximal tubules, alveolar pneumocytes of the lung, bladder, testes, choroid plexus, and thyroid. Recent studies have identified that FolR1 expression is particularly high in triple negative breast cancers (Necela et al. PloS One 2015, 10(3), e0127133).

The term "Melanoma-associated Chondroitin Sulfate Proteoglycan (MCSP)", also known as Chondroitin Sulfate Proteoglycan 4 (CSPG4) refers to any native MCSP from any vertebrate source, including mammals such as primates (e.g. humans) non-human primates (e.g. cynomolgus monkeys) and rodents (e.g. mice and rats), unless otherwise indicated. The amino acid sequence of human MCSP is shown in UniProt accession no. Q6UVK1 (version 103, SEQ ID NO:142). MCSP is a highly glycosylated integral membrane chondroitin sulfate proteoglycan consisting of an N-linked 280 kDa glycoprotein component and a 450-kDa chondroitin sulfate proteoglycan component expressed on the cell membrane (Ross et al., *Arch. Biochem. Biophys.* 1983, 225:370-38). MCSP is more broadly distributed in a number of normal and transformed cells. In particular, MCSP is found in almost all basal cells of the epidermis. MCSP is differentially expressed in melanoma cells, and was found to be expressed in more than 90% of benign nevi and melanoma lesions analyzed. MCSP has also been found to be expressed in tumors of nonmelanocytic origin, including basal cell carcinoma, various tumors of neural crest origin, and in breast carcinomas.

The term "Epidermal Growth Factor Receptor (EGFR)", also named Proto-oncogene c-ErbB-1 or Receptor tyrosine-protein kinase erbB-1, refers to any native EGFR from any vertebrate source, including mammals such as primates (e.g. humans) non-human primates (e.g. cynomolgus monkeys) and rodents (e.g. mice and rats), unless otherwise indicated. The amino acid sequence of human EGFR is shown in UniProt accession no. P00533 (version 211, SEQ ID NO:143). The proto-oncogene "HER2", (human epidermal growth factor receptor 2.) encodes a protein tyrosine kinase (p185HER2) that is related to and somewhat homologous to the human epidermal growth factor receptor. HER2 is also known in the field as c-erbB-2, and sometimes by the name of the rat homolog, neu. Amplification and/or overexpression of HER2 is associated with multiple human malignancies and appears to be integrally involved in progression of 25-30% of human breast and ovarian cancers. Furthermore, the extent of amplification is inversely correlated with the observed median patient survival time (Slamon, D. J. et al., Science 244:707-712 (1989)). The amino acid sequence of human HER2 is shown in UniProt accession no. P04626 (version 230, SEQ ID NO:144). The term "p95HER2" as used herein refers to a carboxy terminal fragment (CTF) of the HER2 receptor protein, which is also known as "611-CTF" or "100-115 kDa p95HER2". The p95HER2 fragment is generated in the cell through initiation of translation of the HER2 mRNA at codon position 611 of the full-length HER2 molecule (Anido et al, EMBO J 25; 3234-44 (2006)). It has a molecular weight of 100 to 115 kDa and is expressed at the cell membrane, where it can form homodimers maintained by intermolecular disulfide bonds (Pedersen et al., Mol Cell Biol 29, 3319-31 (2009)). An exemplary sequence of human p95HER2 is given in SEQ ID NO: 145.

"HER3" or "ErbB3" (human epidermal growth factor receptor 3), like the other members of the ErbB receptor tyrosine kinase family, consists of an extracellular domain, a transmembrane domain, and an intracellular domain. The extracellular domain contains four subdomains (I-IV). Subdomains I and III are leucine-rich and are primarily involved in ligand binding. Subdomains II and IV are cysteine-rich and most likely contribute to protein conformation and stability through the formation of disulfide bonds. Subdomain II also contains the dimerization loop required for dimer formation. The cytoplasmic domain contains a juxtamembrane segment, a kinase domain, and a C-terminal domain. While no evidence has been found that ErbB3 overexpression, constitutive activation, or mutation alone is oncogenic, en.wikipedia.org/wiki/ERBB3—cite_note-pmid8632008-18 the protein as a heterodimerization partner, most critically with ErbB2, is implicated in growth, proliferation, chemotherapeutic resistance, and the promotion of invasion and metastasis. ErbB3 is associated with targeted therapeutic resistance in numerous cancers. The amino acid sequence of human HER3 is shown in UniProt accession no. P21860 (version 224, SEQ ID NO:471)

A "B cell surface antigen" as used herein refers to an antigenic determinant presented on the surface of a B lymphocyte, particularly a malignant B lymphocyte (in that case the antigen also being referred to as "malignant B-cell surface antigen"). Several B-cell surface antigens are interesting in terms of immunotherapy of hematologic malignant neoplasms. In one aspect, the B cell surface antigen is selected from the group consisting of CD19, CD79b, CD20, CD22 and CD37.

The term "CD19" refers to B-lymphocyte antigen CD19, also known as B-lymphocyte surface antigen B4 or T-cell surface antigen Leu-12 and includes any native CD19 from any vertebrate source, including mammals such as primates (e.g. humans) non-human primates (e.g. cynomolgus monkeys) and rodents (e.g. mice and rats), unless otherwise indicated. The amino acid sequence of human CD19 is shown in Uniprot accession no. P15391 (version 160, SEQ ID NO:434). The term encompasses "full-length" unprocessed human CD19 as well as any form of human CD19 that results from processing in the cell as long as the antibody as reported herein binds thereto. CD19 is a structurally distinct cell surface receptor expressed on the surface of human B cells, including, but not limited to, pre-B cells, B cells in early development {i.e., immature B cells), mature B cells through terminal differentiation into plasma cells, and malignant B cells. CD19 is expressed by most pre-B acute lymphoblastic leukemias (ALL), non-Hodgkin's lymphomas, B cell chronic lymphocytic leukemias (CLL), prolymphocytic leukemias, hairy cell leukemias, common acute lymphocytic leukemias, and some Null-acute lymphoblastic leukemias. The expression of CD19 on plasma cells further suggests it may be expressed on differentiated B cell tumors such as multiple myeloma. Therefore, the CD19 antigen is a target for immunotherapy in the treatment of non-Hodgkin's lymphoma, chronic lymphocytic leukemia and/or acute lymphoblastic leukemia.

"CD79b" refers to B-cell antigen receptor complex-associated protein beta chain, also known as Ig-beta or B cell specific glycoprotein B29, and includes any native CD79b from any vertebrate source, including mammals such as primates (e.g. humans) non-human primates (e.g. cynomolgus monkeys) and rodents (e.g. mice and rats), unless otherwise indicated. The amino acid sequence of human CD79b is shown in Uniprot accession no. P40259 (version 180, SEQ ID NO:435). CD79b is a 39 KDa protein exclusively expressed on B cells and, in cooperation with CD79a, initiates the signal transduction cascade downstream of the BCR, which leads to internalization of the BCR complex, its translocation to the endosomes, and antigen presentation. CD79 (composed of subunits CD79a and CD79b) is a heterodimeric signal-transduction component of the B-cell receptor, ubiquitously expressed in mature B-cell lymphomas and placed on the cell surface by the earliest committed B-cell progenitors before expression of immunoglobulin μ. The term "CD79b" encompasses "full-length," unprocessed CD79b as well as any form of CD79b that results from processing in the cell. The term also encompasses naturally occurring variants of CD79b, e.g., splice variants or allelic variants.

"CD20" refers to B-lymphocyte antigen CD20, also known as B-lymphocyte surface antigen B1 or Leukocyte surface antigen Leu-16, and includes any native CD20 from any vertebrate source, including mammals such as primates (e.g. humans) non-human primates (e.g. cynomolgus monkeys) and rodents (e.g. mice and rats), unless otherwise indicated. The amino acid sequence of human CD20 is shown in Uniprot accession no. P11836 (version 149, SEQ ID NO:436). CD20 is a hydrophobic transmembrane protein with a molecular weight of approximately 35 kD expressed on pre-B and mature B lymphocytes. The corresponding human gene is membrane-spanning 4-domains, subfamily A, member 1, also known as MS4A1. This gene encodes a member of the membrane-spanning 4A gene family. Members of this nascent protein family are characterized by common structural features and similar intron/exon splice boundaries and display unique expression patterns among hematopoietic cells and nonlymphoid tissues. This gene encodes the B-lymphocyte surface molecule which plays a role in the development and differentiation of B-cells into plasma cells. This family member is localized to 11q12, among a cluster of family members. Alternative splicing of this gene results in two transcript variants which encode the same protein. The term "CD20" encompasses "full-length," unprocessed CD20 as well as any form of CD20 that results from processing in the cell. The term also encompasses naturally occurring variants of CD20, e.g., splice variants or allelic variants.

"CD22" refers to B-cell receptor CD22, also known as B-lymphocyte cell adhesion molecule or SIGLEC2, and includes any native CD22 from any vertebrate source, including mammals such as primates (e.g. humans) non-human primates (e.g. cynomolgus monkeys) and rodents (e.g. mice and rats), unless otherwise indicated. The amino acid sequence of human CD22 is shown in Uniprot accession no. P20273 (version 209, SEQ ID NO:437). CD22 is a molecule belonging to the SIGLEC family of lectins and is found on the surface of mature B cells and to lesser extent on some immature B cells. CD22 is thus a B cell restricted cell surface phosphoglycoprotein of 130-150 kDa and is capable of modulating B lymphocyte antigen receptor (BCR)-mediated signals, as well as the generation of BCR-independent signals. The term "CD22" encompasses "full-length," unprocessed CD22 as well as any form of CD22 that results from processing in the cell. The term also encompasses naturally occurring variants of CD22, e.g., splice variants or allelic variants.

"CD37" refers to Leukocyte antigen CD37, also known as Tetraspanin-26 (Tspan-26), and includes any native CD37 from any vertebrate source, including mammals such as primates (e.g. humans) non-human primates (e.g. cynomolgus monkeys) and rodents (e.g. mice and rats), unless otherwise indicated. The amino acid sequence of human CD37 is shown in Uniprot accession no. P11049 (version 162, SEQ ID NO:438). CD37 expression is restricted to cells of the immune system, with highest abundance on mature B cells, and lower expression is found on T cells and myeloid cells. The glycoprotein CD37 is a member of the transmembrane 4 superfamily and controls both humoral and cellular immune responses. The term "CD37" encompasses "full-length," unprocessed CD37 as well as any form of CD37 that results from processing in the cell. The term also encompasses naturally occurring variants of CD37, e.g., splice variants or allelic variants.

A "Multiple Myeloma (MM) cell surface antigen" as used herein refers to an antigenic determinant presented on the surface of a Multiple Myeloma (MM) cell. Several MM cell surface antigens are interesting in terms of immunotherapy of Multiple Myeloma. In one aspect, the MM cell surface antigen is selected from the group consisting of CD38, BCMA and GPRC5D.

The term "CD38", also known as cluster of differentiation 38 or cyclic ADP ribose hydrolase, is a glycoprotein found on the surface of many immune cells (white blood cells), including CD4+, CD8+, B lymphocytes and natural killer cells. CD38 also functions in cell adhesion, signal transduction and calcium signaling. Under normal conditions, CD38 is expressed at relatively low levels on myeloid and lymphoid cells and in some non-hematopoietic tissues. In contrast, normal plasma cells and multiple myeloma (MM) cells have high levels of CD38 expression, which makes CD38 an interesting target for targeting cell surface molecules in MM. CD38 as used herein refers to any CD38 protein from any vertebrate source, including mammals such as primates (e.g. humans) non-human primates (e.g. cynomolgus monkeys) and rodents (e.g. mice and rats), unless otherwise indicated. The amino acid sequence of human CD38 is shown in UniProt (world wide web.uniprot.org) accession no. P28907 (SEQ ID NO:474).

The term "BCMA" refers to B cell maturation antigen, also termed tumor necrosis factor receptor superfamily member 17 (TNFRS17), and is a type III transmembrane protein without a signal-peptide and containing cysteine-rich extracellular domains. BCMA is expressed at significantly higher levels in all patient MM cells but not on other normal tissues except normal plasma cells. BCMA, along with two related TNFR superfamily B-cell activation factor receptor (BAFF-R) and transmembrane activator and calcium modulator and cyclophilin ligand interactor (TACI), critically regulate B cell proliferation and survival, as well as maturation and differentiation into plasma cells. These three functionally related receptors support long-term survival of B cells at different stages of development by binding to BAFF and/or APRIL, their cognate ligands. BCMA as used herein refers to any BCMA protein from any vertebrate source, including mammals such as primates (e.g. humans) non-human primates (e.g. cynomolgus monkeys) and rodents (e.g. mice and rats), unless otherwise indicated. The amino acid sequence of human BCMA is shown in UniProt (world wide web.uniprot.org) accession no. Q02223 (SEQ ID NO:475).

The term "GPRC5D" refers to G protein-coupled receptor class C group 5 member D, a target identified from plasma cells in multiple myeloma using RNA-sequencing. It has been reported that GPRC5D is associated with poor prognosis and tumour load in multiple myeloma patients. GPRC5D refers to any GPRC5D protein from any vertebrate source, including mammals such as primates (e.g. humans) non-human primates (e.g. cynomolgus monkeys) and rodents (e.g. mice and rats), unless otherwise indicated. The amino acid sequence of human GPRC5D is shown in UniProt (world wide web.uniprot.org) accession no. Q9NZD1 (SEQ ID NO:476).

The term "CD28" (Cluster of differentiation 28, Tp44) refers to any CD28 protein from any vertebrate source, including mammals such as primates (e.g. humans) non-human primates (e.g. cynomolgus monkeys) and rodents (e.g. mice and rats), unless otherwise indicated. CD28 is expressed on T cells and provides co-stimulatory signals required for T cell activation and survival. T cell stimulation through CD28 in addition to the T-cell receptor (TCR) can provide a potent signal for the production of various interleukins. CD28 is the receptor for CD80 (B7.1) and CD86 (B7.2) proteins and is the only B7 receptor constitutively expressed on naïve T cells. The amino acid sequence of human CD28 is shown in UniProt (world wide web.uniprot.org) accession no. P10747 (SEQ ID NO:1).

An "agonistic antibody" refers to an antibody that comprises an agonistic function against a given receptor. In general, when an agonist ligand (factor) hinds to a receptor, the tertiary structure of the receptor protein changes, and the receptor is activated (when the receptor is a membrane protein, a cell growth signal or such is usually transducted). If the receptor is a dimer-forming type, an agonistic antibody can dimerize the receptor at an appropriate distance and angle, thus acting similarly to a ligand. An appropriate anti-receptor antibody can mimic dimerization of receptors performed by ligands, and thus can become an agonistic antibody.

A "CD28 agonistic antigen binding molecule" or "CD28 conventional agonistic antigen binding molecule" is an antigen binding molecule that mimicks CD28 natural ligands (CD80 or CD86) in their role to enhance T cell activation in presence of a T cell receptor signal ("signal 2"). A T cell needs two signals to become fully activated. Under physiological conditions "signal 1" arises form the interaction of T cell receptor (TCR) molecules with peptide/major histocompatibility complex (MHC) complexes on antigen presenting cells (APCs) and "signal 2" is provided by engagement of a costimulatory receptor, e.g. CD28. A CD28 agonistic antigen binding molecule is able to costimulate T cells (signal 2). It is also able to induce T cell proliferation and cytokine secretion in combination with a molecule with specificity for the TCR complex, however the CD28 agonistic antigen binding molecule is not capable of fully activating T cells without additional stimulation of the TCR. There is however a subclass of CD28 specific antigen binding molecules, the so-called CD28 superagonistic antigen binding molecules. A "CD28 superagonistic antigen binding molecule" is a CD28 antigen binding molecule which is capable of fully activating T cells without additional stimulation of the TCR. A CD28 superagonistic antigen binding molecule is capable to induce T cell proliferation and cytokine secretion without prior T cell activation (signal The term "variable domain" or "variable region" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6th ed. W.H. Freeman and Co., page 91 (2007). A single VH or VL domain may be sufficient to confer antigen-binding specificity.

The term "hypervariable region" or "HVR" as used herein refers to each of the regions of an antigen binding variable domain which are hypervariable in sequence and which determine antigen binding specificity, for example "complementarity determining regions" ("CDRs"). Generally, antigen binding domains comprise six CDRs: three in the VH (CDR-H1, CDR-H2, CDR-H3), and three in the VL (CDR-L1, CDR-L2, CDR-L3). Exemplary CDRs herein include:

(a) hypervariable loops occurring at amino acid residues 26-32 (L1), 50-52 (L2), 91-96 (L3), 26-32 (H1), 53-55 (H2), and 96-101 (H3) (Chothia and Lesk, *J. Mol. Biol.* 196:901-917 (1987));

(b) CDRs occurring at amino acid residues 24-34 (L1), 50-56 (L2), 89-97 (L3), 31-35b (H1), 50-65 (H2), and 95-102 (H3) (Kabat et al., *Sequences of Proteins of Immunological Interest*, 5th Ed. Public Health Service, National Institutes of Health, Bethesda, Md. (1991)); and (c) antigen contacts occurring at amino acid residues 27c-36 (L1), 46-55 (L2), 89-96 (L3), 30-35b (H1), 47-58 (H2), and 93-101 (H3) (MacCallum et al. *J. Mol. Biol.* 262: 732-745 (1996)).

Unless otherwise indicated, the CDRs are determined according to Kabat et al., supra. One of skill in the art will understand that the CDR designations can also be determined according to Chothia, supra, McCallum, supra, or any other scientifically accepted nomenclature. Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified, references to the numbering of specific amino acid residue positions in an antibody variable region are according to the Kabat numbering system.

As used herein, the term "affinity matured" in the context of antigen binding molecules (e.g., antibodies) refers to an antigen binding molecule that is derived from a reference antigen binding molecule, e.g., by mutation, binds to the same antigen, preferably binds to the same epitope, as the reference antibody; and has a higher affinity for the antigen than that of the reference antigen binding molecule. Affinity maturation generally involves modification of one or more amino acid residues in one or more CDRs of the antigen binding molecule. Typically, the affinity matured antigen binding molecule binds to the same epitope as the initial reference antigen binding molecule.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

An "acceptor human framework" for the purposes herein is a framework comprising the amino acid sequence of a light chain variable domain (VL) framework or a heavy chain variable domain (VH) framework derived from a human immunoglobulin framework or a human consensus framework, as defined below. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the VL acceptor human framework is identical in sequence to the VL human immunoglobulin framework sequence or human consensus framework sequence.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g. $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "CI-11 domain" denotes the part of an antibody heavy chain polypeptide that extends approximately from EU position 118 to EU position 215 (EU numbering system according to Kabat). In one aspect, a CH1 domain has the amino acid sequence of ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKKV (SEQ ID NO: 477). Usually, a segment having the amino acid sequence of EPKSC (SEQ ID NO:480) is following to link the CH1 domain to the hinge region, The term "hinge region" denotes the part of an antibody heavy chain polypeptide that joins in a wild-type antibody heavy chain the CH1 domain and the CH2 domain, e. g. from about position 216 to about position 230 according to the EU number system of Kabat, or from about position 226 to about position 230 according to the EU number system of Kabat. The hinge regions of other IgG subclasses can be determined by aligning with the hinge-region cysteine residues of the IgG1 subclass sequence. The hinge region is normally a dimeric molecule consisting of two polypeptides with identical amino acid sequence. The hinge region generally comprises up to 25 amino acid residues and is flexible allowing the associated target binding sites to move independently. The hinge region can be subdivided into three domains: the upper, the middle, and the lower hinge domain (see e.g. Roux, et al., J. Immunol. 161 (1998) 4083).

In one aspect, the hinge region has the amino acid sequence DKTHTCPXCP (SEQ ID NO: 481), wherein X is either S or P. In one aspect, the hinge region has the amino acid sequence HTCPXCP (SEQ ID NO: 482), wherein X is either S or P. In one aspect, the hinge region has the amino acid sequence CPXCP (SEQ ID NO:483), wherein X is either S or P.

The term "Fc domain" or "Fc region" herein is used to define a C-terminal region of an antibody heavy chain that contains at least a portion of the constant region. The term includes native sequence Fc regions and variant Fc regions. An IgG Fc region comprises an IgG CH2 and an IgG CH3 domain.

The "CH2 domain" of a human IgG Fc region usually extends from an amino acid residue at about EU position 231 to an amino acid residue at about EU position 340 (EU numbering system according to Kabat). In one aspect, a CH2 domain has the amino acid sequence of APELLGGPSV FLFPPKPKDT LMISRTPEVT CVWDVSHEDP EVKFNWYVDG VEVHNAKTKP REEQESTYRW SVLTVLHQDW LNGKEYKCKV SNKALPAPIE KTISKAK (SEQ ID NO: 478). The CH2 domain is unique in that it is not closely paired with another domain. Rather, two N-linked branched carbohydrate chains are interposed between the two CH2 domains of an intact native Fc-region. It has been speculated that the carbohydrate may provide a substitute for the domain-domain pairing and help stabilize the CH2 domain. Burton, Mol. Immunol. 22 (1985) 161-206. In one embodiment, a carbohydrate chain is attached to the CH2 domain. The CH2 domain herein may be a native sequence CH2 domain or variant CH2 domain.

The "CH3 domain" comprises the stretch of residues C-terminal to a CH2 domain in an Fc region denotes the part of an antibody heavy chain polypeptide that extends approximately from EU position 341 to EU position 446 (EU numbering system according to Kabat). In one aspect, the CH3 domain has the amino acid sequence of GQPREPQVYT LPPSRDELTK NQVSLTCLVK GFYPSDIAVE WESNGQPENN YKTTPPVLDS DGSFFLYSKL TVDKSRWQQG NVFSCSVMHE ALHNHYTQKS LSLSPG (SEQ ID NO: 479). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof; see U.S. Pat. No. 5,821,333, expressly incorporated herein by reference). Such variant CH3 domains may be used to promote heterodimerization of two non-identical antibody heavy chains as herein described. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The "knob-into-hole" technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W in one of the two subunits of the Fc domain, and the hole modification comprises the amino acid substitutions T366S, L368A and Y407V in the other one of the two subunits of the Fc domain. In a further specific embodiment, the subunit of the Fc domain comprising the knob modification additionally comprises the amino acid substitution S354C, and the subunit of the Fc domain comprising the hole modification additionally comprises the amino acid substitution Y349C. Introduction of these two cysteine residues results in the formation of a disulfide bridge between the two subunits of the Fc region, thus further stabilizing the dimer (Carter, J Immunol Methods 248, 7-15 (2001)).

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cellular cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, J. U. et al., Science 247:1306-10 (1990)).

The term "wild-type Fc domain" denotes an amino acid sequence identical to the amino acid sequence of an Fc domain found in nature. Wild-type human Fc domains include a native human IgG1 Fc-region (non-A and A allotypes), native human IgG2 Fc-region, native human IgG3 Fc-region, and native human IgG4 Fc-region as well as naturally occurring variants thereof. Wild-type Fc-regions are denoted in SEQ ID NO: 484 (IgG1, caucasian allotype), SEQ ID NO: 485 (IgG1, afroamerican allotype), SEQ ID NO: 486 (IgG2), SEQ ID NO: 487 (IgG3) and SEQ ID NO:488 (IgG4).

The term "variant (human) Fc domain" denotes an amino acid sequence which differs from that of a "wild-type"

(human) Fc domain amino acid sequence by virtue of at least one "amino acid mutation". In one aspect, the variant Fc-region has at least one amino acid mutation compared to a native Fc-region, e.g. from about one to about ten amino acid mutations, and in one aspect from about one to about five amino acid mutations in a native Fc-region. In one aspect, the (variant) Fc-region has at least about 95% homology with a wild-type Fc-region.

The term "effector functions" refers to those biological activities attributable to the Fc region of an antibody, which vary with the antibody isotype. Examples of antibody effector functions include: Clq binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

Fc receptor binding dependent effector functions can be mediated by the interaction of the Fc-region of an antibody with Fc receptors (FcRs), which are specialized cell surface receptors on hematopoietic cells. Fc receptors belong to the immunoglobulin superfamily, and have been shown to mediate both the removal of antibody-coated pathogens by phagocytosis of immune complexes, and the lysis of erythrocytes and various other cellular targets (e.g. tumor cells) coated with the corresponding antibody, via antibody dependent cell mediated cytotoxicity (ADCC) (see e.g. Van de Winkel, J. G. and Anderson, C. L., J. Leukoc. Biol. 49 (1991) 511-524). FcRs are defined by their specificity for immunoglobulin isotypes: Fc receptors for IgG antibodies are referred to as FcγR. Fc receptor binding is described e.g. in Ravetch, J. V. and Kinet, J. P., Annu. Rev. Immunol. 9 (1991) 457-492; Capel, P. J., et al., Immunomethods 4 (1994) 25-34; de Haas, M., et al., J. Lab. Clin. Med. 126 (1995) 330-341; and Gessner, J. E., et al., Ann. Hematol. 76 (1998) 231-248.

Cross-linking of receptors for the Fc-region of IgG antibodies (FcγR) triggers a wide variety of effector functions including phagocytosis, antibody-dependent cellular cytotoxicity, and release of inflammatory mediators, as well as immune complex clearance and regulation of antibody production. In humans, three classes of FcγR have been characterized, which are:

FcγRI (CD64) binds monomeric IgG with high affinity and is expressed on macrophages, monocytes, neutrophils and eosinophils. Modification in the Fc-region IgG at least at one of the amino acid residues E233-G236, P238, D265, N297, A327 and P329 (numbering according to EU index of Kabat) reduce binding to FcγRI. IgG2 residues at positions 233-236, substituted into IgG1 and IgG4, reduced binding to FcγRI by $10^3$-fold and eliminated the human monocyte response to antibody-sensitized red blood cells (Armour, K. L., et al., Eur. J. Immunol. 29 (1999) 2613-2624).

FcγRII (CD32) binds complexed IgG with medium to low affinity and is widely expressed. This receptor can be divided into two sub-types, FcγRIIA and FcγRIIB. FcγRIIA is found on many cells involved in killing (e.g. macrophages, monocytes, neutrophils) and seems able to activate the killing process. FcγRIIB seems to play a role in inhibitory processes and is found on B cells, macrophages and on mast cells and eosinophils. On B-cells it seems to function to suppress further immunoglobulin production and isotype switching to, for example, the IgE class. On macrophages, FcγRIIB acts to inhibit phagocytosis as mediated through FcγRIIA. On eosinophils and mast cells the B-form may help to suppress activation of these cells through IgE binding to its separate receptor. Reduced binding for FcγRIIA is found e.g. for antibodies comprising an IgG Fc-region with mutations at least at one of the amino acid residues E233-G236, P238, D265, N297, A327, P329, D270, Q295, A327, R292, and K414 (numbering according to EU index of Kabat).

FcγRIII (CD16) binds IgG with medium to low affinity and exists as two types. FcγRIIIA is found on NK cells, macrophages, eosinophils and some monocytes and T cells and mediates ADCC. FcγRIIIB is highly expressed on neutrophils. Reduced binding to FcγRIIIA is found e.g. for antibodies comprising an IgG Fc-region with mutation at least at one of the amino acid residues E233-G236, P238, D265, N297, A327, P329, D270, Q295, A327, S239, E269, E293, Y296, V303, A327, K338 and D376 (numbering according to EU index of Kabat).

Mapping of the binding sites on human IgG1 for Fc receptors, the above mentioned mutation sites and methods for measuring binding to FcγRI and FcγRIIA are described in Shields, R. L., et al. J. Biol. Chem. 276 (2001) 6591-6604.

The term "ADCC" or "antibody-dependent cellular cytotoxicity" is an immune mechanism leading to lysis of antibody-coated target cells by immune effector cells. The target cells are cells to which antibodies or derivatives thereof comprising an Fc region specifically bind, generally via the protein part that is N-terminal to the Fc region. As used herein, the term "reduced ADCC" is defined as either a reduction in the number of target cells that are lysed in a given time, at a given concentration of antibody in the medium surrounding the target cells, by the mechanism of ADCC defined above, and/or an increase in the concentration of antibody in the medium surrounding the target cells, required to achieve the lysis of a given number of target cells in a given time, by the mechanism of ADCC. The reduction in ADCC is relative to the ADCC mediated by the same antibody produced by the same type of host cells, using the same standard production, purification, formulation and storage methods (which are known to those skilled in the art), but that has not been engineered. For example, the reduction in ADCC mediated by an antibody comprising in its Fc domain an amino acid substitution that reduces ADCC, is relative to the ADCC mediated by the same antibody without this amino acid substitution in the Fc domain. Suitable assays to measure ADCC are well known in the art (see e.g. PCT publication no. WO 2006/082515 or PCT publication no. WO 2012/130831). For example, the capacity of the antibody to induce the initial steps mediating ADCC is investigated by measuring their binding to Fcγ receptors expressing cells, such as cells, recombinantly expressing FcγRI and/or FcγRIIA or NK cells (expressing essentially FcγRIIIA). In particular, binding to FcγR on NK cells is measured.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a), FcγRI (CD64), FcγRIIa (CD32), and FcαRI (CD89). A particular activating Fc receptor is human FcγRIIIa (see UniProt accession no. P08637, version 141).

An "ectodomain" is the domain of a membrane protein that extends into the extracellular space (i.e. the space outside the target cell). Ectodomains are usually the parts of proteins that initiate contact with surfaces, which leads to signal transduction.

The term "peptide linker" refers to a peptide comprising one or more amino acids, typically about 2 to 20 amino acids. Peptide linkers are known in the art or are described herein. Suitable, non-immunogenic linker peptides are, for example, $(G_4S)_n$, $(SG_4)_n$ or $G_4(SG_4)_n$ peptide linkers, wherein "n" is generally a number between 1 and 5, typically between 2 and 4, in particular 2, i.e. the peptides selected from the group consisting of GGGGS (SEQ ID NO:146) GGGGSGGGGS (SEQ ID NO:147), SGGGGSGGGG (SEQ ID NO:148) and GGGGSGGGGSGGGG (SEQ ID NO:149), but also include the sequences GSPGSSSSGS (SEQ ID NO:150), $(G4S)_3$ (SEQ ID NO:151), $(G4S)_4$ (SEQ ID NO:152), GSGSGSGS (SEQ ID NO:153), GSGSGNGS (SEQ ID NO:154), GGSGSGSG (SEQ ID NO:155), GGSGSG (SEQ ID NO:156), GGSG (SEQ ID NO:157), GGSGNGSG (SEQ ID NO:158), GGNGSGSG (SEQ ID NO:159) and GGNGSG (SEQ ID NO:160). Peptide linkers of particular interest are (G4S) (SEQ ID NO:146), $(G_4S)_2$ or GGGGSGGGGS (SEQ ID NO:147), $(G4S)_3$ (SEQ ID NO:151) and $(G4S)_4$ (SEQ ID NO:152).

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

By "fused" or "connected" is meant that the components (e.g. a polypeptide and an ectodomain of said TNF ligand family member) are linked by peptide bonds, either directly or via one or more peptide linkers.

"Percent (%) amino acid sequence identity" with respect to a reference polypeptide (protein) sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN. SAWI or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows: 100 times the fraction X/Y, where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

In certain embodiments, amino acid sequence variants of the CD28 antigen binding molecules provided herein are contemplated. For example, it may be desirable to improve the binding affinity and/or other biological properties of the CD28 antigen binding molecules. Amino acid sequence variants of the CD28 antigen binding molecules may be prepared by introducing appropriate modifications into the nucleotide sequence encoding the molecules, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE A

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;

(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) *Science*, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of insertions include CD28 antigen binding molecules with a fusion to the N- or C-terminus to a polypeptide which increases the serum half-life of the CD28 antigen binding molecules.

In certain embodiments, the CD28 antigen binding molecules provided herein are altered to increase or decrease the extent to which the antibody is glycosylated. Glycosylation variants of the molecules may be conveniently obtained by altering the amino acid sequence such that one or more glycosylation sites is created or removed. Where the agonistic ICOS-binding molecule comprises an Fc domain, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in agonistic ICOS-binding molecules may be made in order to create variants with certain improved properties. In one aspect, variants of agonistic ICOS-binding molecules are provided having a carbohydrate structure that lacks fucose attached (directly or indirectly) to an Fc region. Such fucosylation variants may have improved ADCC function, see e.g. US Patent Publication Nos. US 2003/0157108 (Presta, L.) or US 2004/0093621 (Kyowa Hakko Kogyo Co., Ltd). Further variants of the CD28 antigen binding molecules of the invention include those with bisected oligosaccharides, e.g., in which a biantennary oligosaccharide attached to the Fc region is bisected by GlcNAc. Such variants may have reduced fucosylation and/or improved ADCC function., see for example WO 2003/011878 (Jean-Mairet et al.); U.S. Pat. No. 6,602,684 (Umana et al.); and US 2005/0123546 (Umana et al.). Variants with at least one galactose residue in the oligosaccharide attached to the Fc region are also provided. Such antibody variants may have improved CDC function and are described, e.g., in WO 1997/30087 (Patel et al.); WO 1998/58964 (Raju, S.); and WO 1999/22764 (Raju, S.).

In certain embodiments, it may be desirable to create cysteine engineered variants of the CD28 antigen binding molecules of the invention, e.g., "thioMAbs," in which one or more residues of the molecule are substituted with cysteine residues. In particular embodiments, the substituted residues occur at accessible sites of the molecule. By substituting those residues with cysteine, reactive thiol groups are thereby positioned at accessible sites of the antibody and may be used to conjugate the antibody to other moieties, such as drug moieties or linker-drug moieties, to create an immunoconjugate. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antigen binding molecules may be generated as described, e.g., in U.S. Pat. No. 7,521,541.

In certain aspects, the CD28 antigen binding molecules provided herein may be further modified to contain additional non-proteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1, 3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the bispecific antibody derivative will be used in a therapy under defined conditions, etc. In another aspect, conjugates of an antibody and non-proteinaceous moiety that may be selectively heated by exposure to radiation are provided. In one embodiment, the non-proteinaceous moiety is a carbon nanotube (Kam, N. W. et al., Proc. Natl. Acad. Sci. USA 102 (2005) 11600-11605). The radiation may be of any wavelength, and includes, but is not limited to, wavelengths that do not harm ordinary cells, but which heat the non-proteinaceous moiety to a temperature at which cells proximal to the antibody-non-proteinaceous moiety are killed. In another aspect, immunoconjugates of the CD28 antigen binding molecules provided herein maybe obtained. An "immunoconjugate" is an antibody conjugated to one or more heterologous molecule(s), including but not limited to a cytotoxic agent.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA). The term "nucleic acid molecule" refers to any one or more nucleic acid segments, e.g. DNA or RNA fragments, present in a polynucleotide. Each nucleotide is composed of a base, specifically a purine- or pyrimidine base (i.e. cytosine (C), guanine (G), adenine (A), thymine (T) or uracil (U)), a sugar (i.e. deoxyribose or ribose), and a phosphate group. Often, the nucleic acid molecule is described by the sequence of bases, whereby said bases represent the primary structure (linear structure) of a nucleic acid molecule. The sequence of bases is typically represented from 5' to 3'. Herein, the term nucleic acid molecule encompasses deoxyribonucleic acid (DNA) including e.g., complementary DNA (cDNA) and genomic DNA, ribonucleic acid (RNA), in particular messenger RNA (mRNA), synthetic forms of DNA or RNA, and mixed polymers comprising two or more of these molecules. The nucleic acid molecule may be linear or circular. In addition, the term nucleic acid molecule includes both, sense and antisense strands, as well as single stranded and double stranded forms. Moreover, the herein described nucleic acid molecule can contain naturally occurring or non-naturally occurring nucleotides. Examples of non-naturally occurring nucleotides include modified nucleotide bases with derivatized sugars or phosphate backbone linkages or chemically modified residues. Nucleic acid molecules also encompass DNA and RNA molecules which are suitable as a vector for direct expression of an antibody of the invention in vitro and/or in vivo, e.g., in a host or patient. Such DNA (e.g., cDNA) or RNA (e.g., mRNA) vectors, can be unmodified or modified. For example, mRNA can be chemically modified to enhance the stability of the RNA vector and/or expression of the encoded molecule so that mRNA can be injected into a subject to generate the antibody in vivo (see e.g., Stadler et al. (2017) Nature Medicine 23:815-817, or EP 2 101 823 B1).

By "isolated" nucleic acid molecule or polynucleotide is intended a nucleic acid molecule, DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof.

The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0 cells, Y0 myeloma cells, P3X63 mouse myeloma cells, PER cells, PER.C6 cells or hybridoma cells, yeast cells, insect cells, and plant cells, to name only a few, but also cells comprised within a transgenic animal, transgenic plant or cultured plant or animal tissue.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, the molecules of the invention are used to delay development of a disease or to slow the progression of a disease.

The term "combination treatment" or "co-administration" as noted herein encompasses combined administration (where two or more therapeutic agents are included in the same or separate formulations), and separate administration, in which case, administration of an antibody as reported herein can occur prior to, simultaneously, and/or following, administration of the additional therapeutic agent or agents, preferably an antibody or antibodies.

By "B cell proliferative disorder" is meant a disease wherein the number of B cells in a patient is increased as compared to the number of B cells in a healthy subject, and particularly wherein the increase in the number of B cells is the cause or hallmark of the disease.

The term "hematological cancer" refers to or describes the physiological condition in mammals that is typically characterized by unregulated cell growth/proliferation. Thus, the term cancer as used herein refers to proliferative diseases, such as carcinoma, lymphomas (e.g., Hodgkin's and non-Hodgkin's lymphoma), blastoma, sarcoma, and leukemia. In particular, the term cancer refers to a B-cell proliferative disorder. In one aspect, the cancer is selected from the group consisting of Non-Hodgkin lymphoma (NHL), acute lymphocytic leukemia (ALL), chronic lymphocytic leukemia (CLL), diffuse large B-cell lymphoma (DLBCL), follicular lymphoma (FL), mantle-cell lymphoma (MCL), marginal zone lymphoma (MZL), Multiple myeloma (MM), and Hodgkin lymphoma (HL).

The term "cancer" refers to or describes the physiological condition in mammals that is typically characterized by unregulated cell growth/proliferation. Thus, the term cancer as used herein refers to proliferative diseases, such as carcinoma, lymphomas (e.g., Hodgkin's and non-Hodgkin's lymphoma), blastoma, sarcoma, and leukemia. In particular, the term cancer includes lymphocytic leukemias, lung cancer, non-small cell lung (NSCL) cancer, bronchioloalviolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma and Ewings sarcoma, including refractory versions of any of the above cancers, or a combination of one or more of the above cancers. In one aspect, the cancer is a solid tumor. In another aspect, the cancer is a haematological cancer, particularly leukemia, most particularly acute lymphoblastic leukemia (ALL) or acute myelogenous leukemia (AML).

Bispecific Agonistic CD28 Antigen Binding Molecules of the Invention

The invention provides novel bispecific agonistic CD28 antigen binding molecules with particularly advantageous properties such as producibility, stability, binding affinity, biological activity, targeting efficiency, reduced toxicity, an extended dosage range that can be given to a patient and thereby a possibly enhanced efficacy. The novel bispecific agonistic CD28 antigen binding molecules comprise an Fc domain composed of a first and a second subunit capable of stable association comprising one or more amino acid substitution that reduces the binding affinity of the antigen binding molecule to an Fc receptor and/or effector function (Fc silent) and thus unspecific cross-linking via Fc receptors is avoided. Instead, they comprise at least one antigen binding domain capable of specific binding to a tumor-associated antigen such as Fibroblast Activation Protein (FAP) or Carcinoembryonic Antigen (CEA) which causes cross-linking at the tumor site. Thus, tumor-specific T cell activation is achieved.

Herein provided is a bispecific agonistic CD28 antigen binding molecule with monovalent binding to CD28, comprising
(a) one antigen binding domains capable of specific binding to CD28,
(b) at least one antigen binding domain capable of specific binding to a tumor-associated antigen, and
(c) an Fc domain composed of a first and a second subunit capable of stable association comprising one or more amino acid substitution that reduces the binding affinity of the antigen binding molecule to an Fc receptor and/or effector function.

In one aspect, a bispecific agonistic CD28 antigen binding molecule as defined herein before is provided, wherein the Fc domain is an IgG, particularly an IgG1 Fc domain or an IgG4 Fc domain. In one particular aspect, the Fc domain composed of a first and a second subunit capable of stable association is an IgG1 Fc domain. The Fc domain comprises one or more amino acid substitution that reduces the binding affinity of the antigen binding molecule to an Fc receptor and/or reduces or abolishes effector function. In one aspect, the Fc domain comprises the amino acid substitutions L234A and L235A (numbering according to Kabat EU index). In one aspect, the Fc domain is of human IgG1 subclass and comprises the amino acid mutations L234A, L235A and P329G (numbering according to Kabat EU index). In one aspect, a bispecific agonistic CD28 antigen binding molecule is provided, wherein the antigen binding molecule comprises an Fc domain composed of a first and a second subunit capable of stable association, wherein the first subunit comprises the amino acid sequence of SEQ ID NO:176 and the second subunit comprise the amino acid sequence of SEQ ID NO:177.

In one aspect, provided is a bispecific agonistic CD28 antigen binding molecule as defined herein before, wherein the antigen binding domain capable of specific binding to CD28 comprises
(i) a heavy chain variable region ($V_H$CD28) comprising a heavy chain complementary determining region CDR-H1 of SEQ ID NO: 20, a CDR-H2 of SEQ ID NO: 21, and a CDR-H3 of SEQ ID NO: 22, and a light chain variable region ($V_L$CD28) comprising a light chain complementary determining region CDR-L1 of SEQ ID NO: 23, a CDR-L2 of SEQ ID NO: 24 and a CDR-L3 of SEQ ID NO: 25; or
(ii) a heavy chain variable region ($V_H$CD28) comprising a CDR-H1 of SEQ ID NO: 36, a CDR-H2 of SEQ ID NO: 37, and a CDR-H3 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

In one aspect, the antigen binding domain capable of specific binding to CD28 of the bispecific agonistic CD28 antigen binding molecule comprises a heavy chain variable region ($V_H$CD28) comprising a CDR-H1 of SEQ ID NO: 36, a CDR-H2 of SEQ ID NO: 37, and a CDR-1-13 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

In another aspect, the antigen binding domain capable of specific binding to CD28 of the bispecific agonistic CD28 antigen binding molecule comprises a heavy chain variable region ($V_H$CD28) comprising a CDR-H1 of SEQ ID NO: 20, a CDR-H2 of SEQ ID NO: 21, and a CDR-H3 of SEQ ID NO: 22, and a light chain variable region ($V_L$CD28) comprising a CDR-L1 of SEQ ID NO: 23, a CDR-L2 of SEQ ID NO: 24 and a CDR-L3 of SEQ ID NO: 25.

Furthermore, provided is a bispecific agonistic CD28 antigen binding molecule as defined herein before, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:26, and a light chain variable region ($V_L$CD28) comprising an amino acid sequence that is at least about 95%, 96%, 97%, 98%, 99% or 100% identical to the amino acid sequence of SEQ ID NO:27.

In another aspect, provided is bispecific agonistic CD28 antigen binding molecule, wherein the antigen binding domain capable of specific binding to CD28 comprises
(a) the CDRs of the heavy chain variable region ($V_H$CD28) comprising the amino acid sequence of SEQ ID NO:47 and the CDRs of the light chain variable region ($V_L$CD28) comprising the amino acid sequence of SEQ ID NO:54, or
(b) the CDRs of the heavy chain variable region ($V_H$CD28) comprising the amino acid sequence of SEQ ID NO:47 and the CDRs of the light chain variable region ($V_L$CD28) comprising the amino acid sequence of SEQ ID NO:27, or
(c) the CDRs of the heavy chain variable region ($V_H$CD28) comprising the amino acid sequence of SEQ ID NO:51 and the CDRs of the light chain variable region ($V_L$CD28) comprising the amino acid sequence of SEQ ID NO:61, or
(d) the CDRs of the heavy chain variable region ($V_H$CD28) comprising the amino acid sequence of SEQ ID NO:46 and the CDRs of the light chain variable region ($V_L$CD28) comprising the amino acid sequence of SEQ ID NO:53, or
(e) the CDRs of the heavy chain variable region ($V_H$CD28) comprising the amino acid sequence of SEQ ID NO:46 and the CDRs of the light chain variable region ($V_L$CD28) comprising the amino acid sequence of SEQ ID NO:54, or
(f) the CDRs of the heavy chain variable region ($V_H$CD28) comprising the amino acid sequence of SEQ ID NO:46 and the CDRs of the light chain variable region ($V_L$CD28) comprising the amino acid sequence of SEQ ID NO:59, or
(g) the CDRs of the heavy chain variable region ($V_H$CD28) comprising the amino acid sequence of SEQ ID NO:46 and the CDRs of the light chain variable region ($V_L$CD28) comprising the amino acid sequence of SEQ ID NO:27, or
(h) the CDRs of the heavy chain variable region ($V_H$CD28) comprising the amino acid sequence of SEQ ID NO:43 and the CDRs of the light chain variable region ($V_L$CD28) comprising the amino acid sequence of SEQ ID NO:27, or
(i) the CDRs of the heavy chain variable region ($V_H$CD28) comprising the amino acid sequence of SEQ ID NO:42 and the CDRs of the light chain variable region (V$_L$CD28) comprising the amino acid sequence of SEQ ID NO:53, or (j) the CDRs of the heavy chain variable region (V$_H$CD28) comprising the amino acid sequence of SEQ ID NO:42 and the CDRs of the light chain variable region (V$_L$CD28) comprising the amino acid sequence of SEQ ID NO:59, or (k) the CDRs of the heavy chain variable region (V$_H$CD28) comprising the amino acid sequence of SEQ ID NO:42 and the CDRs of the light chain variable region (V$_L$CD28) comprising the amino acid sequence of SEQ ID NO:27.

In one aspect, provided is a bispecific agonistic CD28 antigen binding molecule, wherein the antigen binding domain capable of specific binding to CD28 comprises the CDRs of the heavy chain variable region (V$_H$CD28) comprising the amino acid sequence of SEQ ID NO:47 and the CDRs of the light chain variable region (V$_L$CD28) comprising the amino acid sequence of SEQ ID NO:54. In another aspect, the antigen binding domain capable of specific binding to CD28 of the bispecific agonistic CD28 antigen binding molecule comprises a heavy chain variable region (V$_H$CD28) comprising a CDR-H1 of SEQ ID NO: 489, a CDR-H2 of SEQ ID NO: 490, and a CDR-H3 of SEQ TD NO: 491, and a light chain variable region (V$_L$CD28) comprising a CDR-L1 of SEQ ID NO: 492, a CDR-L2 of SEQ ID NO: 493 and a CDR-L3 of SEQ ID NO: 494.

In another aspect, provided is a bispecific agonistic CD28 antigen binding molecule, wherein the antigen binding domain capable of specific binding to CD28 comprises the CDRs of the heavy chain variable region (V$_H$CD28) comprising the amino acid sequence of SEQ ID NO:46 and the CDRs of the light chain variable region (V$_L$CD28) comprising the amino acid sequence of SEQ ID NO:53. In another aspect, the antigen binding domain capable of specific binding to CD28 of the bispecific agonistic CD28 antigen binding molecule comprises a heavy chain variable region (V$_H$CD28) comprising a CDR-H1 of SEQ ID NO: 495, a CDR-H2 of SEQ ID NO: 496, and a CDR-H3 of SEQ ID NO: 497, and a light chain variable region (V$_L$CD28) comprising a CDR-L1 of SEQ ID NO: 498, a CDR-L2 of SEQ ID NO: 499 and a CDR-L3 of SEQ ID NO: 500.

In another aspect, provided is a bispecific agonistic CD28 antigen binding molecule, wherein the antigen binding domain capable of specific binding to CD28 comprises the CDRs of the heavy chain variable region (V$_H$CD28) comprising the amino acid sequence of SEQ ID NO:42 and the CDRs of the light chain variable region (V$_L$CD28) comprising the amino acid sequence of SEQ ID NO:27. In another aspect, the antigen binding domain capable of specific binding to CD28 of the bispecific agonistic CD28 antigen binding molecule comprises a heavy chain variable region (V$_H$CD28) comprising a CDR-H1 of SEQ ID NO: 501, a CDR-H2 of SEQ ID NO: 502, and a CDR-H3 of SEQ ID NO: 503, and a light chain variable region (V$_L$CD28) comprising a CDR-L1 of SEQ ID NO: 504, a CDR-L2 of SEQ ID NO: 505 and a CDR-L3 of SEQ ID NO: 506.

In a further aspect, a bispecific agonistic CD28 antigen binding molecule is provided, wherein the antigen binding domain capable of specific binding to CD28 comprises a heavy chain variable region (V$_H$CD28) comprising an amino acid sequence selected from the group consisting of SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50 and SEQ ID NO:51, and a light chain variable region (V$_L$CD28) comprising an amino acid sequence selected from the group consisting of SEQ ID NO:27, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60 and SEQ ID NO:61.

In another aspect, provided is bispecific agonistic CD28 antigen binding molecule, wherein the antigen binding domain capable of specific binding to CD28 comprises (a) a heavy chain variable region (V$_H$CD28) comprising the amino acid sequence of SEQ ID NO:47 and a light chain variable region (V$_L$CD28) comprising the amino acid sequence of SEQ ID NO:54, or (b) a heavy chain variable region (V$_H$CD28) comprising the amino acid sequence of SEQ II) NO:47 and a light chain variable region (V$_L$CD28) comprising the amino acid sequence of SEQ ID NO:27, or (c) a heavy chain variable region (V$_H$CD28) comprising the amino acid sequence of SEQ ID NO:51 and a light chain variable region (V$_L$CD28) comprising the amino acid sequence of SEQ ID NO:61, or (d) a heavy chain variable region (V$_H$CD28) comprising the amino acid sequence of SEQ ID NO:46 and a light chain variable region (V$_L$CD28) comprising the amino acid sequence of SEQ ID NO:53, or (e) a heavy chain variable region (V$_H$CD28) comprising the amino acid sequence of SEQ ID NO:46 and a light chain variable region (V$_L$CD28) comprising the amino acid sequence of SEQ ID NO:54, or (f) a heavy chain variable region (V$_H$CD28) comprising the amino acid sequence of SEQ ID NO:46 and a light chain variable region (V$_L$CD28) comprising the amino acid sequence of SEQ ID NO:59, or (g) a heavy chain variable region (V$_H$CD28) comprising the amino acid sequence of SEQ ID NO:46 and a light chain variable region (V$_L$CD28) comprising the amino acid sequence of SEQ ID NO:27, or (h) a heavy chain variable region (V$_H$CD28) comprising the amino acid sequence of SEQ ID NO:43 and a light chain variable region (V$_L$CD28) comprising the amino acid sequence of SEQ ID NO:27, or (i) a heavy chain variable region (V$_H$CD28) comprising the amino acid sequence of SEQ ID NO:42 and a light chain variable region (V$_L$CD28) comprising the amino acid sequence of SEQ ID NO:53, or (j) a heavy chain variable region (V$_H$CD28) comprising the amino acid sequence of SEQ ID NO:42 and a light chain variable region (V$_L$CD28) comprising the amino acid sequence of SEQ ID NO:59, or (k) a heavy chain variable region (V$_H$CD28) comprising the amino acid sequence of SEQ ID NO:42 and a light chain variable region (V$_L$CD28) comprising the amino acid sequence of SEQ ID NO:27.

In one aspect, a bispecific agonistic CD28 antigen binding molecule is provided, wherein the antigen binding domain capable of specific binding to CD28 binds to CD28 with an reduced affinity compared to an antigen binding domain comprising a heavy chain variable region (V$_H$CD28) comprising the amino acid sequence of SEQ ID NO:26 and a light chain variable region (V$_L$CD28) comprising the amino acid sequence of SEQ ID NO:27. The affinity is measured by flow cytometry as binding to CHO cells expressing CD28. In one aspect, the antigen binding domain capable of specific binding to CD28 binds to CD28 with an reduced affinity compared to an antigen binding domain comprising a heavy chain variable region (V$_H$CD28) comprising the amino acid sequence of SEQ ID NO:26 and a light chain variable region (V$_L$CD28) comprising the amino acid sequence of SEQ ID NO:27 comprises the CDR-H1, CDR-H2 and CDR-H3 of the heavy chain variable region (V$_H$CD28) comprising the amino acid sequence of SEQ ID NO:47 and the CDR-L1, CDR-L2 and CDR-L3 of the light chain variable region (V$_L$CD28) comprising the amino acid sequence of SEQ ID NO:54. In one aspect, the antigen binding domain capable of specific binding to CD28 with reduced affinity compared to an antigen binding domain comprising a heavy chain variable region (V$_H$CD28) comprising the amino acid sequence of SEQ ID NO:26 and a light chain variable region (V$_L$CD28) comprising the amino acid sequence of SEQ ID NO:27 comprises a heavy chain variable region (V$_H$CD28) comprising an amino acid sequence that is at least about 95%, 96%, 97%, 98%, 99% or 100% identical to the amino acid sequence of SEQ ID NO:47, and a light chain variable region (V$_L$CD28) comprising an amino acid sequence that is at least about 95%, 96%, 97%, 98%, 99% or 100% identical to the amino acid sequence of SEQ ID NO:54.

In one particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:47 and a light chain variable region (V$_L$CD28) comprising the amino acid sequence of SEQ ID NO:54.

In another particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:46 and a light chain variable region (V$_L$CD28) comprising the amino acid sequence of SEQ ID NO:53.

In further particular aspect, a bispecific agonistic CD28 antigen binding molecule is provided, wherein the antigen binding domain capable of specific binding to CD28 comprises a heavy chain variable region (V$_H$CD28) comprising the amino acid sequence of SEQ ID NO:42 and a light chain variable region (V$_L$CD28) comprising the amino acid sequence of SEQ ID NO:27.

CEA-Targeting Bispecific Agonistic CD28 Antigen Binding Molecules

In one aspect, a bispecific agonistic CD28 antigen binding molecule is provided, wherein the antigen binding domain capable of specific binding to a tumor-associated antigen is an antigen binding domain capable of specific binding to Carcinoembryonic Antigen (CEA).

In one aspect, provided is a bispecific agonistic CD28 antigen binding molecule as described herein, wherein the antigen binding domain capable of specific binding to CEA comprises
(i) a heavy chain variable region (V$_H$CEA) comprising a CDR-H1 comprising the amino acid sequence of SEQ ID NO:188, a CDR-H2 comprising the amino acid sequence of SEQ ID NO:189, and a CDR-H3 comprising the amino acid sequence of SEQ ID NO:190, and a light chain variable region (V$_L$CEA) comprising a CDR-L1 comprising the amino acid sequence of SEQ ID NO:191, a CDR-L2 comprising the amino acid sequence of SEQ ID NO:192, and a CDR-L3 comprising the amino acid sequence of SEQ ID NO:193; or
(ii) a heavy chain variable region (V$_H$CEA) comprising a CDR-H1 comprising the amino acid sequence of SEQ ID NO:180, a CDR-H2 comprising the amino acid sequence of SEQ ID NO:181, and a CDR-H3 comprising the amino acid sequence of SEQ ID NO:182, and a light chain variable region (V$_L$CEA) comprising a CDR-L1 comprising the amino acid sequence of SEQ ID NO:183, a CDR-L2 comprising the amino acid sequence of SEQ ID NO:184, and a CDR-L3 comprising the amino acid sequence of SEQ ID NO:185; or
(iii) a heavy chain variable region (V$_H$CEA) comprising a CDR-H1 comprising the amino acid sequence of SEQ ID NO:127, a CDR-H2 comprising the amino acid sequence of SEQ ID NO:128, and a CDR-H3 comprising the amino acid sequence of SEQ ID NO:129, and a light chain variable region (V$_L$CEA) comprising a CDR-L1 comprising the amino acid sequence of SEQ ID NO:130, a CDR-L2 comprising the amino acid sequence of SEQ ID NO:131, and a CDR-L3 comprising the amino acid sequence of SEQ ID NO:132, or
(iv) a heavy chain variable region (V$_H$CEA) comprising a CDR-H1 comprising the amino acid sequence of SEQ ID NO:507, a CDR-H2 comprising the amino acid sequence of SEQ ID NO:508, and a CDR-H3 comprising the amino acid sequence of SEQ ID NO:509, and a light chain variable region (V$_L$CEA) comprising a CDR-L1 comprising the amino acid sequence of SEQ ID NO:510, a CDR-L2 comprising the amino acid sequence of SEQ ID NO:511, and a CDR-L3 comprising the amino acid sequence of SEQ ID NO:512.

In one particular aspect, the antigen binding domain capable of specific binding to CEA comprises a heavy chain variable region (V$_H$CEA) comprising a CDR-H1 comprising the amino acid sequence of SEQ ID NO:188, a CDR-H2 comprising the amino acid sequence of SEQ ID NO:189, and a CDR-H3 comprising the amino acid sequence of SEQ ID NO:190, and a light chain variable region (V$_L$CEA) comprising a CDR-L1 comprising the amino acid sequence of SEQ ID NO:191, a CDR-L2 comprising the amino acid sequence of SEQ ID NO:192, and a CDR-L3 comprising the amino acid sequence of SEQ ID NO:193.

Particularly, the antigen binding domain capable of specific binding to CEA comprises a heavy chain variable region (V$_H$CEA) comprising an amino acid sequence that is at least about 95%, 96%, 97%, 98%, 99% or 100% identical to the amino acid sequence of SEQ ID NO:133, and a light chain variable region (V$_L$CEA) comprising an amino acid sequence that is at least about 95%, 96%, 97%, 98%, 99% or 100% identical to the amino acid sequence of SEQ ID NO:134. In one aspect, the antigen binding domain capable of specific binding to CEA comprises a heavy chain variable region (V$_H$CEA) comprising an amino acid sequence of SEQ ID NO:133, and a light chain variable region (V$_L$CEA) comprising the amino acid sequence of SEQ ID NO:134.

In another aspect, the antigen binding domain capable of specific binding to CEA comprises a heavy chain variable region (V$_H$CEA) comprising an amino acid sequence that is at least about 95%, 96%, 97%, 98%, 99% or 100% identical to the amino acid sequence of SEQ ID NO:186, and a light chain variable region (V$_L$CEA) comprising an amino acid sequence that is at least about 95%, 96%, 97%, 98%, 99% or 100% identical to the amino acid sequence of SEQ ID NO:187. In one aspect, the antigen binding domain capable of specific binding to CEA comprises a heavy chain variable region (V$_H$CEA) comprising an amino acid sequence of SEQ ID NO:186, and a light chain variable region (V$_L$CEA) comprising the amino acid sequence of SEQ ID NO:187.

In another aspect, the antigen binding domain capable of specific binding to CEA comprises a heavy chain variable region (V$_H$CEA) comprising an amino acid sequence that is at least about 95%, 96%, 97%, 98%, 99% or 100% identical to the amino acid sequence of SEQ ID NO:513, and a light chain variable region (V$_L$CEA) comprising an amino acid sequence that is at least about 95%, 96%, 97%, 98%, 99% or 100% identical to the amino acid sequence of SEQ ID NO:514. In one aspect, the antigen binding domain capable of specific binding to CEA comprises a heavy chain variable region ($V_H$CEA) comprising an amino acid sequence of SEQ ID NO:513, and a light chain variable region ($V_L$CEA) comprising the amino acid sequence of SEQ ID NO:514.

In another aspect, provided is a bispecific agonistic CD28 antigen binding molecule, wherein the antigen binding domain capable of specific binding to CEA comprises (a) a heavy chain variable region ($V_H$CEA) comprising the amino acid sequence of SEQ ID NO:194 and a light chain variable region ($V_L$CEA) comprising the amino acid sequence of SEQ ID NO:195, or (b) a heavy chain variable region ($V_H$CEA) comprising the amino acid sequence of SEQ ID NO:196 and a light chain variable region ($V_L$CEA) comprising the amino acid sequence of SEQ ID NO:197, or (c) a heavy chain variable region ($V_H$CEA) comprising the amino acid sequence of SEQ ID NO:198 and a light chain variable region ($V_L$CEA) comprising the amino acid sequence of SEQ ID NO: I 99, or (d) a heavy chain variable region ($V_H$CEA) comprising the amino acid sequence of SEQ ID NO:200 and a light chain variable region ($V_L$CEA) comprising the amino acid sequence of SEQ ID NO:201, or (e) a heavy chain variable region ($V_H$CEA) comprising the amino acid sequence of SEQ ID NO:202 and a light chain variable region ($V_L$CEA) comprising the amino acid sequence of SEQ ID NO:203, or (f) a heavy chain variable region ($V_H$CEA) comprising the amino acid sequence of SEQ ID NO:204 and a light chain variable region ($V_L$CEA) comprising the amino acid sequence of SEQ ID NO:205, or (g) a heavy chain variable region ($V_H$CEA) comprising the amino acid sequence of SEQ ID NO:206 and a light chain variable region ($V_L$CEA) comprising the amino acid sequence of SEQ ID NO:207, or (h) a heavy chain variable region ($V_H$CEA) comprising the amino acid sequence of SEQ ID NO:208 and a light chain variable region ($V_L$CEA) comprising the amino acid sequence of SEQ ID NO:209, or (i) a heavy chain variable region ($V_H$CEA) comprising the amino acid sequence of SEQ ID NO:210 and a light chain variable region ($V_L$CEA) comprising the amino acid sequence of SEQ ID NO:211, or (j) a heavy chain variable region ($V_H$CEA) comprising the amino acid sequence of SEQ ID NO:212 and a light chain variable region ($V_L$CEA) comprising the amino acid sequence of SEQ ID NO:213.

Particularly, the antigen binding domain capable of specific binding to CEA comprises a heavy chain variable region ($V_H$CEA) comprising the amino acid sequence of SEQ ID NO:200 and a light chain variable region ($V_L$CEA) comprising the amino acid sequence of SEQ ID NO:201.

FAP-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to Fibroblast Activation Protein (FAP).

In one aspect, provided is a bispecific agonistic CD28 antigen binding molecule as described herein, wherein the antigen binding domain capable of specific binding to FAP comprises (a) a heavy chain variable region ($V_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region ($V_L$FAP) comprising (iv) CDR-L1 comprising the amino acid sequence of SEQ ID NO:15, (v) CDR-L2 comprising the amino acid sequence of SEQ ID NO: 16, and (vi) CDR-L3 comprising the amino acid sequence of SEQ ID NO:17, or (b) a heavy chain variable region ($V_H$FAP) comprising (i) CDR-H1 comprising the amino acid sequence of SEQ ID NO:4, (ii) CDR-H2 comprising the amino acid sequence of SEQ ID NO:5, and (iii) CDR-H3 comprising the amino acid sequence of SEQ ID NO:6, and a light chain variable region ($V_L$FAP) comprising (iv) CDR-L1 comprising the amino acid sequence of SEQ ID NO:7, (v) CDR-L2 comprising the amino acid sequence of SEQ ID NO:8, and (vi) CDR-L3 comprising the amino acid sequence of SEQ ID NO:9.

In particular, the antigen binding domain capable of specific binding to FAP comprises a heavy chain variable region ($V_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region ($V_L$FAP) comprising (iv) CDR-L1 comprising the amino acid sequence of SEQ ID NO:15, (v) CDR-L2 comprising the amino acid sequence of SEQ ID NO:16, and (vi) CDR-L3 comprising the amino acid sequence of SEQ ID NO:17. In one aspect, a bispecific agonistic CD28 antigen binding molecule is provided, wherein the antigen binding domain capable of specific binding to FAP comprises (a) a heavy chain variable region ($V_H$FAP) comprising an amino acid sequence that is at least about 95%, 96%, 97%, 98%, 99% or 100% identical to the amino acid sequence of SEQ ID NO:18, and a light chain variable region ($V_L$FAP) comprising an amino acid sequence that is at least about 95%, 96%, 97%, 98%, 99% or 100% identical to the amino acid sequence of SEQ ID NO:19, or (b) a heavy chain variable region ($V_H$FAP) comprising an amino acid sequence that is at least about 95%, 96%, 97%, 98%, 99% or 100% identical to the amino acid sequence of SEQ ID NO:10, and a light chain variable region ($V_L$FAP) comprising an amino acid sequence that is at least about 95%, 96%, 97%, 98%, 99% or 100% identical to the amino acid sequence of SEQ ID NO:11. Particularly, the antigen binding domain capable of specific binding to FAP comprises a heavy chain variable region ($V_H$FAP) comprising the amino acid sequence of SEQ ID NO:18 and a light chain variable region ($V_L$FAP) comprising the amino acid sequence of SEQ ID NO:19.

EpCAM-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to epithelial cell adhesion molecule (EpCAM).

In one aspect, provided is a bispecific agonistic CD28 antigen binding molecule as described herein, wherein the antigen binding domain capable of specific binding to EpCAM comprises a heavy chain variable region ($V_H$Ep-CAM) comprising (i) CDR-H1 comprising the amino acid sequence of SEQ ID NO:515, (ii) CDR-H2 comprising the amino acid sequence of SEQ ID NO:516, and (iii) CDR-H3 comprising the amino acid sequence of SEQ ID NO:517, and a light chain variable region ($V_L$EpCAM) comprising (iv) CDR-L1 comprising the amino acid sequence of SEQ ID NO:518, (v) CDR-L2 comprising the amino acid sequence of SEQ ID NO:519, and (vi) CDR-L3 comprising the amino acid sequence of SEQ ID NO:520. In one aspect, a bispecific agonistic CD28 antigen binding molecule is provided, wherein the antigen binding domain capable of specific binding to EpCAM comprises a heavy chain variable region ($V_H$EpCAM) comprising an amino acid sequence that is at least about 95%, 96%, 97%, 98%, 99% or 100% identical to the amino acid sequence of SEQ ID NO:521, and a light chain variable region ($V_L$EpCAM) comprising an amino acid sequence that is at least about 95%, 96%, 97%, 98%, 99% or 100% identical to the amino acid sequence of SEQ ID NO:522. Particularly, the antigen binding domain capable of specific binding to EpCAM comprises a heavy chain variable region ($V_H$EpCAM) comprising the amino acid sequence of SEQ ID NO:521 and a light chain variable region ($V_L$EpCAM) comprising the amino acid sequence of SEQ ID NO:522.

HER3-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to HER3.

In one aspect, provided is a bispecific agonistic CD28 antigen binding molecule as described herein, wherein the antigen binding domain capable of specific binding to HER3 comprises a heavy chain variable region ($V_H$HER3) comprising (i) CDR-H1 comprising the amino acid sequence of SEQ ID NO:523, (ii) CDR-H2 comprising the amino acid sequence of SEQ ID NO:524, and (iii) CDR-H3 comprising the amino acid sequence of SEQ ID NO:525, and a light chain variable region ($V_L$HER3) comprising (iv) CDR-L1 comprising the amino acid sequence of SEQ ID NO:526, (v) CDR-L2 comprising the amino acid sequence of SEQ ID NO:527, and (vi) CDR-L3 comprising the amino acid sequence of SEQ ID NO:528. In one aspect, a bispecific agonistic CD28 antigen binding molecule is provided, wherein the antigen binding domain capable of specific binding to HER3 comprises a heavy chain variable region ($V_H$HER3) comprising an amino acid sequence that is at least about 95%, 96%, 97%, 98%, 99% or 100% identical to the amino acid sequence of SEQ ID NO:529, and a light chain variable region ($V_L$HER3) comprising an amino acid sequence that is at least about 95%, 96%, 97%, 98%, 99% or 100% identical to the amino acid sequence of SEQ ID NO:530. Particularly, the antigen binding domain capable of specific binding to HER3 comprises a heavy chain variable region ($V_H$HER3) comprising the amino acid sequence of SEQ ID NO:529 and a light chain variable region ($V_L$HER3) comprising the amino acid sequence of SEQ ID NO:530.

CD30-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to CD30.

In one aspect, provided is a bispecific agonistic CD28 antigen binding molecule as described herein, wherein the antigen binding domain capable of specific binding to CD30 comprises a heavy chain variable region ($V_H$CD30) comprising (i) CDR-H1 comprising the amino acid sequence of SEQ ID NO:531, (ii) CDR-H2 comprising the amino acid sequence of SEQ ID NO:532, and (iii) CDR-H3 comprising the amino acid sequence of SEQ ID NO:533, and a light chain variable region ($V_L$CD30) comprising (iv) CDR-L1 comprising the amino acid sequence of SEQ ID NO:534, (v) CDR-L2 comprising the amino acid sequence of SEQ ID NO:535, and (vi) CDR-L3 comprising the amino acid sequence of SEQ ID NO:536. In one aspect, a bispecific agonistic CD28 antigen binding molecule is provided, wherein the antigen binding domain capable of specific binding to CD30 comprises a heavy chain variable region ($V_H$CD30) comprising an amino acid sequence that is at least about 95%, 96%, 97%, 98%, 99% or 100% identical to the amino acid sequence of SEQ ID NO:537, and a light chain variable region ($V_L$CD30) comprising an amino acid sequence that is at least about 95%, 96%, 97%, 98%, 99% or 100% identical to the amino acid sequence of SEQ ID NO:538. Particularly, the antigen binding domain capable of specific binding to CD30 comprises a heavy chain variable region ($V_H$CD30) comprising the amino acid sequence of SEQ ID NO:537 and a light chain variable region ($V_L$CD30) comprising the amino acid sequence of SEQ ID NO:538.

TBPG (5T4)-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to TBPG (5T4).

In one aspect, provided is a bispecific agonistic CD28 antigen binding molecule as described herein, wherein the antigen binding domain capable of specific binding to TBPG comprises a heavy chain variable region ($V_H$TBPG) comprising (i) CDR-H1 comprising the amino acid sequence of SEQ ID NO:539, (ii) CDR-H2 comprising the amino acid sequence of SEQ ID NO:540, and (iii) CDR-H3 comprising the amino acid sequence of SEQ ID NO:541, and a light chain variable region ($V_L$TBPG) comprising (iv) CDR-L1 comprising the amino acid sequence of SEQ ID NO:542, (v) CDR-L2 comprising the amino acid sequence of SEQ ID NO:543, and (vi) CDR-L3 comprising the amino acid sequence of SEQ ID NO:544. In one aspect, a bispecific agonistic CD28 antigen binding molecule is provided, wherein the antigen binding domain capable of specific binding to TBPG comprises a heavy chain variable region ($V_H$TBPG) comprising an amino acid sequence that is at least about 95%, 96%, 97%, 98%, 99% or 100% identical to the amino acid sequence of SEQ ID NO:545, and a light chain variable region ($V_L$TBPG) comprising an amino acid sequence that is at least about 95%, 96%, 97%, 98%, 99% or 100% identical to the amino acid sequence of SEQ ID NO:546. Particularly, the antigen binding domain capable of specific binding to TBPG comprises a heavy chain variable region ($V_H$TBPG) comprising the amino acid sequence of SEQ ID NO:545 and a light chain variable region ($V_L$TBPG) comprising the amino acid sequence of SEQ ID NO:546.

MM-Targeting Bispecific Agonistic CD28 Antigen Binding Molecules

The invention also provides novel bispecific agonistic CD28 antigen binding molecules that are particularly useful in the treatment of multiple myeloma. The molecules comprise at least one antigen binding domain capable of specific binding to a Multiple Myeloma (MM) cell surface antigen which causes cross-linking in the presence of MM cell surface antigen-expressing cells and an Fc domain composed of a first and a second subunit capable of stable association comprising one or more amino acid substitution that reduces the binding affinity of the antigen binding molecule to an Fc receptor and/or effector function (Fc silent). Thus unspecific cross-linking via Fc receptors is avoided and specific T cell activation in the presence of MM cell surface antigen-expressing cells is achieved.

Thus, herein provided is a bispecific agonistic CD28 antigen binding molecule comprising an antigen binding domain capable of specific binding to CD28, an antigen binding domain capable of specific binding to a Multiple Myeloma (MM) cell surface antigen, and a Fc domain composed of a first and a second subunit capable of stable association comprising one or more amino acid substitution that reduces the binding affinity of the antigen binding molecule to an Fc receptor and/or effector function. In one aspect, the bispecific agonistic CD28 antigen binding molecule as described herein is characterized by monovalent binding to CD28. In a further aspect, the bispecific agonistic CD28 antigen binding molecule as described herein is characterized by monovalent binding to the Multiple Myeloma (MM) cell surface antigen.

In one aspect, a bispecific agonistic CD28 antigen binding molecule as defined herein before is provided, wherein the Fc domain is an IgG, particularly an IgG1 Fc domain or an IgG4 Fc domain. In one particular aspect, the Fc domain composed of a first and a second subunit capable of stable association is an IgG1 Fc domain. The Fc domain comprises one or more amino acid substitution that reduces the binding affinity of the antigen binding molecule to an Fc receptor and/or reduces or abolishes effector function. In one aspect, the Fc domain comprises the amino acid substitutions L234A and L235A (numbering according to Kabat EU index). In one aspect, the Fc domain is of human IgG1 subclass and comprises the amino acid mutations L234A, L235A and P329G (numbering according to Kabat EU index).

In one aspect, a bispecific agonistic CD28 antigen binding molecule as defined herein before is provided, wherein the MM cell surface antigen is selected from the group consisting of CD38, BCMA and GPRC5D.

In another aspect, a bispecific agonistic CD28 antigen binding molecule is provided, wherein the antigen binding domain capable of specific binding to a tumor-associated antigen is an antigen binding domain capable of specific binding to CD38.

In one aspect, provided is a bispecific agonistic CD28 antigen binding molecule as described herein, wherein the antigen binding domain capable of specific binding to CD38 comprises a heavy chain variable region ($V_H$CD38) comprising (i) CDR-H1 comprising the amino acid sequence of SEQ ID NO:547, (ii) CDR-H2 comprising the amino acid sequence of SEQ ID NO:548, and (iii) CDR-H3 comprising the amino acid sequence of SEQ ID NO:549, and a light chain variable region ($V_L$CD38) comprising (iv) CDR-L1 comprising the amino acid sequence of SEQ ID NO:550, (v) CDR-L2 comprising the amino acid sequence of SEQ ID NO:551, and (vi) CDR-L3 comprising the amino acid sequence of SEQ ID NO:552. In one aspect, a bispecific agonistic CD28 antigen binding molecule is provided, wherein the antigen binding domain capable of specific binding to CD38 comprises a heavy chain variable region ($V_H$CD38) comprising an amino acid sequence that is at least about 95%, 96%, 97%, 98%, 99% or 100% identical to the amino acid sequence of SEQ ID NO:553, and a light chain variable region ($V_L$CD38) comprising an amino acid sequence that is at least about 95%, 96%, 97%, 98%, 99% or 100% identical to the amino acid sequence of SEQ ID NO:554. Particularly, the antigen binding domain capable of specific binding to CD38 comprises a heavy chain variable region ($V_H$CD38) comprising the amino acid sequence of SEQ ID NO:553 and a light chain variable region ($V_L$CD38) comprising the amino acid sequence of SEQ ID NO:554.

In yet another aspect, a bispecific agonistic CD28 antigen binding molecule is provided, wherein the antigen binding domain capable of specific binding to a tumor-associated antigen is an antigen binding domain capable of specific binding to BCMA.

In one aspect, provided is a bispecific agonistic CD28 antigen binding molecule as described herein, wherein the antigen binding domain capable of specific binding to BCMA comprises a heavy chain variable region ($V_H$BCMA) comprising (i) CDR-H1 comprising the amino acid sequence of SEQ ID NO:555, (ii) CDR-112 comprising the amino acid sequence of SEQ ID NO:556, and (iii) CDR-H3 comprising the amino acid sequence of SEQ ID NO:557, and a light chain variable region ($V_L$BCMA) comprising (iv) CDR-L1 comprising the amino acid sequence of SEQ ID NO:558, (v) CDR-L2 comprising the amino acid sequence of SEQ ID NO:559, and (vi) CDR-L3 comprising the amino acid sequence of SEQ ID NO:560. In one aspect, a bispecific agonistic CD28 antigen binding molecule is provided, wherein the antigen binding domain capable of specific binding to BCMA comprises a heavy chain variable region ($V_H$BCMA) comprising an amino acid sequence that is at least about 95%, 96%, 97%, 98%, 99% or 100% identical to the amino acid sequence of SEQ ID NO:561, and a light chain variable region ($V_L$BCMA) comprising an amino acid sequence that is at least about 95%, 96%, 97%, 98%, 99% or 100% identical to the amino acid sequence of SEQ ID NO:562. Particularly, the antigen binding domain capable of specific binding to BCMA comprises a heavy chain variable region ($V_H$BCMA) comprising the amino acid sequence of SEQ ID NO:561 and a light chain variable region ($V_L$BCMA) comprising the amino acid sequence of SEQ ID NO:562.

GPRC5D-Targeting Bispecific Agonistic CD28 Antigen Binding Molecules

In another aspect, a bispecific agonistic CD28 antigen binding molecule is provided, wherein the antigen binding domain capable of specific binding to a tumor-associated antigen is an antigen binding domain capable of specific binding to GPRC5D.

In one aspect, provided is a bispecific agonistic CD28 antigen binding molecule as described herein, wherein the antigen binding domain capable of specific binding to GPRC5D comprises a heavy chain variable region ($V_H$GPRC5D) comprising (i) CDR-H1 comprising the amino acid sequence of SEQ ID NO:563, (ii) CDR-H2 comprising the amino acid sequence of SEQ ID NO:564, and (iii) CDR-H3 comprising the amino acid sequence of SEQ ID NO:565, and a light chain variable region ($V_L$GPRC5D) comprising (iv) CDR-L1 comprising the amino acid sequence of SEQ ID NO:566, (v) CDR-L2 comprising the amino acid sequence of SEQ ID NO:567, and (vi) CDR-L3 comprising the amino acid sequence of SEQ ID NO:568.

In one aspect, a bispecific agonistic CD28 antigen binding molecule is provided, wherein the antigen binding domain capable of specific binding to GPRC5D comprises a heavy chain variable region ($V_H$GPRC5D) comprising an amino acid sequence selected from the group consisting of SEQ ID NO:569, SEQ ID NO:571, SEQ ID NO:572 and SEQ ID NO:573 and a light chain variable region ($V_L$GPRC5D) comprising an amino acid sequence selected from the group consisting of SEQ ID NO:570, SEQ ID NO:574, SEQ ID NO:575, SEQ ID NO:576, SEQ ID NO:577 and SEQ ID NO:578.

In one aspect, a bispecific agonistic CD28 antigen binding molecule is provided, wherein the antigen binding domain capable of specific binding to GPRC5D comprises a heavy chain variable region (V$_H$GPRC5D) comprising an amino acid sequence that is at least about 95%, 96%, 97%, 98%, 99% or 100% identical to the amino acid sequence of SEQ ID NO:569, and a light chain variable region (V$_L$GPRC5D) comprising an amino acid sequence that is at least about 95%, 96%, 97%, 98%, 99% or 100% identical to the amino acid sequence of SEQ ID NO:570. Particularly, the antigen binding domain capable of specific binding to GPRC5D comprises a heavy chain variable region (V$_H$GPRC5D) comprising the amino acid sequence of SEQ ID NO:569 and a light chain variable region (V$_L$GPRC5D) comprising the amino acid sequence of SEQ ID NO:570.

In another aspect, provided is a bispecific agonistic CD28 antigen binding molecule as described herein, wherein the antigen binding domain capable of specific binding to GPRC5D comprises a heavy chain variable region (V$_H$GPRC5D) comprising (i) CDR-H1 comprising the amino acid sequence of SEQ ID NO:579, (ii) CDR-H2 comprising the amino acid sequence of SEQ ID NO:580, and (iii) CDR-H3 comprising the amino acid sequence of SEQ ID NO:581, and a light chain variable region (V$_L$GPRC5D) comprising (iv) CDR-L1 comprising the amino acid sequence of SEQ ID NO:582, (v) CDR-L2 comprising the amino acid sequence of SEQ ID NO:583, and (vi) CDR-L3 comprising the amino acid sequence of SEQ ID NO:584.

In one aspect, a bispecific agonistic CD28 antigen binding molecule is provided, wherein the antigen binding domain capable of specific binding to GPRC5D comprises a heavy chain variable region (V$_H$GPRC5D) comprising an amino acid sequence selected from the group consisting of SEQ ID NO: 585, SEQ ID NO: 586, SEQ ID NO: 587, SEQ ID NO: 588, SEQ ID NO: 589 and SEQ ID NO:590 and a light chain variable region (V$_L$GPRC5D) comprising an amino acid sequence selected from the group consisting of SEQ ID NO: 591, SEQ ID NO: 592, SEQ ID NO: 593, SEQ ID NO: 594 and SEQ ID NO: 595.

In another aspect, provided is bispecific agonistic CD28 antigen binding molecule, wherein the antigen binding domain capable of specific binding to GPRC5D comprises (a) a heavy chain variable region (V$_H$GPRC5D) comprising the amino acid sequence of SEQ ID NO:569 and a light chain variable region (V$_L$GPRC5D) comprising the amino acid sequence of SEQ ID NO:570, or (b) a heavy chain variable region (V$_H$GPRC5D) comprising the amino acid sequence of SEQ ID NO:573 and a light chain variable region (V$_L$GPRC5D) comprising the amino acid sequence of SEQ ID NO:576, or (c) a heavy chain variable region (V$_H$GPRC5D) comprising the amino acid sequence of SEQ ID NO:569 and a light chain variable region (V$_L$GPRC5D) comprising the amino acid sequence of SEQ ID NO:572, or (d) a heavy chain variable region (V$_H$GPRC5D) comprising the amino acid sequence of SEQ ID NO:586 and a light chain variable region (V$_L$GPRC5D) comprising the amino acid sequence of SEQ ID NO:593, or (e) a heavy chain variable region (V$_H$GPRC5D) comprising the amino acid sequence of SEQ ID NO:587 and a light chain variable region (V$_L$GPRC5D) comprising the amino acid sequence of SEQ ID NO:592.

Bispecific Agonistic CD28 Antigen Binding Molecules Monovalent for Binding to CD28 and Monovalent for Binding to the Tumor-Associated Antigen (1+1 Format)

In another aspect, provided is a bispecific agonistic CD28 antigen binding molecule as described herein, comprising
(a) one Fab fragment capable of specific binding to CD28,
(b) one crossFab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28,
(b) one crossFab fragment capable of specific binding to CEA, and
(c) a Fc domain composed of a first and a second subunit capable of stable association comprising one or more amino acid substitution that reduces the binding affinity of the antigen binding molecule to an Fc receptor and/or effector function.

In one particular aspect, provided is a bispecific agonistic CD28 antigen binding molecule comprising a first light chain comprising the amino acid sequence of SEQ ID NO:65, a first heavy chain comprising the amino acid sequence of SEQ ID NO:66, a second heavy chain comprising the amino acid sequence of SEQ ID NO:87 and a second light chain comprising the amino acid sequence of SEQ ID NO:88 (Molecule M).

In another aspect, provided is a bispecific agonistic CD28 antigen binding molecule as described herein, comprising
(a) one Fab fragment capable of specific binding to CD28,
(b) one crossFab fragment capable of specific binding to FAP, and
(c) a Fc domain composed of a first and a second subunit capable of stable association comprising one or more amino acid substitution that reduces the binding affinity of the antigen binding molecule to an Fc receptor and/or effector function.

In one particular aspect, provided is a bispecific agonistic CD28 antigen binding molecule comprising a first light chain comprising the amino acid sequence of SEQ ID NO:65, a first heavy chain comprising the amino acid sequence of SEQ ID NO:66, a second heavy chain comprising the amino acid sequence of SEQ ID NO:67 and a second light chain comprising the amino acid sequence of SEQ ID NO:68 (Molecule C).

In a further aspect, provided is a bispecific agonistic CD28 antigen binding molecule as described herein, comprising
(a) a first Fab fragment capable of specific binding to CD28,
(b) a second Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of one of the Fc domain subunits.

In one particular aspect, provided is a bispecific agonistic CD28 antigen binding molecule comprising a first light chain comprising the amino acid sequence of SEQ ID NO:77, a second light chain comprising the amino acid sequence of SEQ ID NO:78, a first heavy chain comprising the amino acid sequence of SEQ ID NO:75, and a second heavy chain comprising the amino acid sequence of SEQ ID NO:79 (Molecule H).

In a further aspect, provided is a bispecific agonistic CD28 antigen binding molecule as described herein, comprising
(a) a Fab fragment capable of specific binding to CD28,
(b) a VH and VL domain capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the Fab fragment capable of specific binding to CD28 is fused at its C-terminus to the N-terminus of the first Fc domain subunit, and wherein one of the VH and VL domain capable of specific binding to a tumor-associated antigen is fused via a peptide linker to the C-terminus of the first Fc domain subunit and the other one of the VH and VL domain capable of specific binding to a tumor-associated antigen is fused via a peptide linker to the C-terminus of the second Fc domain subunit.

In one aspect, the peptide linker comprises an amino acid sequence selected from SEQ ID NO:146, SEQ ID NO:147, SEQ ID NO:151 and SEQ ID NO:152. More particularly, the peptide linker comprises the SEQ ID NO:152.

In one particular aspect, provided is a bispecific agonistic CD28 antigen binding molecule comprising a light chain comprising the amino acid sequence of SEQ ID NO:62, a first heavy chain comprising the amino acid sequence of SEQ ID NO:72, and a second heavy chain comprising the amino acid sequence of SEQ ID NO:80 (Molecule I).

In one aspect, provided is a bispecific agonistic CD28 antigen binding molecule as described herein, comprising
(a) one Fab fragment capable of specific binding to CD28 comprising
(i) a heavy chain variable region ($V_H$CD28) comprising the amino acid sequence of SEQ ID NO:47 and a light chain variable region ($V_L$CD28) comprising the amino acid sequence of SEQ ID NO:54,
(ii) a heavy chain variable region ($V_H$CD28) comprising the amino acid sequence of SEQ ID NO:46 and a light chain variable region ($V_L$CD28) comprising the amino acid sequence of SEQ ID NO:53, or
(iii) a heavy chain variable region ($V_H$CD28) comprising the amino acid sequence of SEQ ID NO:42 and a light chain variable region ($V_L$CD28) comprising the amino acid sequence of SEQ ID NO:27,
(b) one crossFab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28 comprising
(i) a heavy chain variable region ($V_H$CD28) comprising the amino acid sequence of SEQ ID NO:47 and a light chain variable region ($V_L$CD28) comprising the amino acid sequence of SEQ ID NO:54, or
(ii) a heavy chain variable region ($V_H$CD28) comprising the amino acid sequence of SEQ ID NO:46 and a light chain variable region ($V_L$CD28) comprising the amino acid sequence of SEQ ID NO:53, or
(iii) a heavy chain variable region ($V_H$CD28) comprising the amino acid sequence of SEQ ID NO:42 and a light chain variable region ($V_L$CD28) comprising the amino acid sequence of SEQ ID NO:27,
(b) one crossFab fragment capable of specific binding to CEA comprising
(i) a heavy chain variable region ($V_H$CEA) comprising the amino acid sequence of SEQ ID NO:186 and a light chain variable region ($V_L$CEA) comprising the amino acid sequence of SEQ ID NO:187, or
(ii) a heavy chain variable region ($V_H$CEA) comprising the amino acid sequence of SEQ ID NO:200 and a light chain variable region ($V_L$CEA) comprising the amino acid sequence of SEQ ID NO:201, or
(iii) a heavy chain variable region ($V_H$CEA) comprising the amino acid sequence of SEQ ID NO:513 and a light chain variable region ($V_L$CEA) comprising the amino acid sequence of SEQ ID NO:514,
and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule comprising a first light chain comprising the amino acid sequence of SEQ ID NO:352, a first heavy chain comprising the amino acid sequence of SEQ ID NO:351, a second heavy chain comprising the amino acid sequence of SEQ ID NO:353 and a second light chain comprising the amino acid sequence of SEQ ID NO:354 (Molecule 11A). In one aspect, provided is a bispecific agonistic CD28 antigen binding molecule comprising a first light chain comprising the amino acid sequence of SEQ ID NO:352, a first heavy chain comprising the amino acid sequence of SEQ ID NO:351, a second heavy chain comprising the amino acid sequence of SEQ ID NO:355 and a second light chain comprising the amino acid sequence of SEQ ID NO:356 (Molecule 11B). In one aspect, provided is a bispecific agonistic CD28 antigen binding molecule comprising a first light chain comprising the amino acid sequence of SEQ ID NO:352, a first heavy chain comprising the amino acid sequence of SEQ ID NO:351, a second heavy chain comprising the amino acid sequence of SEQ ID NO:357 and a second light chain comprising the amino acid sequence of SEQ ID NO:358 (Molecule 11C). In one aspect, provided is a bispecific agonistic CD28 antigen binding molecule comprising a first light chain comprising the amino acid sequence of SEQ ID NO:352, a first heavy chain comprising the amino acid sequence of SEQ ID NO:351, a second heavy chain comprising the amino acid sequence of SEQ ID NO:359 and a second light chain comprising the amino acid sequence of SEQ ID NO:354 (Molecule 11D). In one aspect, provided is a bispecific agonistic CD28 antigen binding molecule comprising a first light chain comprising the amino acid sequence of SEQ ID NO:370, a first heavy chain comprising the amino acid sequence of SEQ ID NO:369, a second heavy chain comprising the amino acid sequence of SEQ ID NO:353 and a second light chain comprising the amino acid sequence of SEQ ID NO:356 (Molecule 11I). In one aspect, provided is a bispecific agonistic CD28 antigen binding molecule comprising a first light chain comprising the amino acid sequence of SEQ ID NO:370, a first heavy chain comprising the amino acid sequence of SEQ ID NO:369, a second heavy chain comprising the amino acid sequence of SEQ ID NO:359 and a second light chain comprising the amino acid sequence of SEQ ID NO:354 (Molecule 11J). In one aspect, provided is a bispecific agonistic CD28 antigen binding molecule comprising a first light chain comprising the amino acid sequence of SEQ ID NO:370, a first heavy chain comprising the amino acid sequence of SEQ ID NO:369, a second heavy chain comprising the amino acid sequence of SEQ ID NO:357 and a second light chain comprising the amino acid sequence of SEQ ID NO:358 (Molecule 11K). In one aspect, provided is a bispecific agonistic CD28 antigen binding molecule comprising a first light chain comprising the amino acid sequence of SEQ ID NO:370, a first heavy chain comprising the amino acid sequence of SEQ ID NO:369, a second heavy chain comprising the amino acid sequence of SEQ ID NO:359 and a second light chain comprising the amino acid sequence of SEQ ID NO:356 (Molecule 11L). In one aspect, the bispecific agonistic CD28 antigen binding molecule comprises a first light chain comprising the amino acid sequence of SEQ ID NO:376, a first heavy chain comprising the amino acid sequence of SEQ ID NO:375, a second heavy chain comprising the amino acid sequence of SEQ ID NO:357 and a second light chain comprising the amino acid sequence of SEQ ID NO:358 (Molecule 11R). In one aspect, the bispecific agonistic CD28 antigen binding molecule comprises a first light chain comprising the amino acid sequence of SEQ ID NO:376, a first heavy chain comprising the amino acid sequence of SEQ ID NO:375, a second heavy chain comprising the amino acid sequence of SEQ ID NO:355 and a second light chain comprising the amino acid sequence of SEQ ID NO:356 (Molecule 11S). In one aspect, the bispecific agonistic CD28 antigen binding molecule comprises a first light chain comprising the amino acid sequence of SEQ ID NO:376, a first heavy chain comprising the amino acid sequence of SEQ ID NO:375, a second heavy chain comprising the amino acid sequence of SEQ ID NO:355 and a second light chain comprising the amino acid sequence of SEQ ID NO:354 (Molecule 11T).

In one particular aspect, the bispecific agonistic CD28 antigen binding molecule comprises a first light chain comprising the amino acid sequence of SEQ ID NO:376, a first heavy chain comprising the amino acid sequence of SEQ ID NO:375, a second heavy chain comprising the amino acid sequence of SEQ ID NO:355 and a second light chain comprising the amino acid sequence of SEQ ID NO:356 (Molecule 11S). In another particular aspect, provided is a bispecific agonistic CD28 antigen binding molecule comprising a first light chain comprising the amino acid sequence of SEQ ID NO:352, a first heavy chain comprising the amino acid sequence of SEQ ID NO:351, a second heavy chain comprising the amino acid sequence of SEQ ID NO:355 and a second light chain comprising the amino acid sequence of SEQ ID NO:356 (Molecule 11B).

In another aspect, provided is a bispecific agonistic CD28 antigen binding molecule as described herein, comprising
(a) one crossFab fragment capable of specific binding to CD28,
(b) one Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one crossFab fragment capable of specific binding to CD28,
(b) one Fab fragment capable of specific binding to CEA, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one crossFab fragment capable of specific binding to CD28 comprising
(i) a heavy chain variable region ($V_H$CD28) comprising the amino acid sequence of SEQ ID NO:47 and a light chain variable region ($V_L$CD28) comprising the amino acid sequence of SEQ ID NO:54, or
(ii) a heavy chain variable region ($V_H$CD28) comprising the amino acid sequence of SEQ ID NO:46 and a light chain variable region ($V_L$CD28) comprising the amino acid sequence of SEQ ID NO:53, or
(iii) a heavy chain variable region ($V_H$CD28) comprising the amino acid sequence of SEQ ID NO:42 and a light chain variable region ($V_L$CD28) comprising the amino acid sequence of SEQ ID NO:27,
(b) one Fab fragment capable of specific binding to CEA comprising
(i) a heavy chain variable region ($V_H$CEA) comprising the amino acid sequence of SEQ ID NO:186 and a light chain variable region ($V_L$CEA) comprising the amino acid sequence of SEQ ID NO:187, or
(ii) a heavy chain variable region ($V_H$CEA) comprising the amino acid sequence of SEQ ID NO:200 and a light chain variable region ($V_L$CEA) comprising the amino acid sequence of SEQ ID NO:201, or
(iii) a heavy chain variable region ($V_L$CEA) comprising the amino acid sequence of SEQ ID NO:513 and a light chain variable region ($V_L$CEA) comprising the amino acid sequence of SEQ ID NO:514,
and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:361, a first heavy chain comprising the amino acid sequence of SEQ ID NO:360, a second heavy chain comprising the amino acid sequence of SEQ ID NO:362 and a second light chain comprising the amino acid sequence of SEQ ID NO:363 (Molecule 11E). In one aspect, the bispecific agonistic CD28 antigen binding molecule comprises a first light chain comprising the amino acid sequence of SEQ ID NO:361, a first heavy chain comprising the amino acid sequence of SEQ ID NO:360, a second heavy chain comprising the amino acid sequence of SEQ ID NO:364 and a second light chain comprising the amino acid sequence of SEQ ID NO:365 (Molecule 11F). In one aspect, the bispecific agonistic CD28 antigen binding molecule comprises a first light chain comprising the amino acid sequence of SEQ ID NO:361, a first heavy chain comprising the amino acid sequence of SEQ ID NO:360, a second heavy chain comprising the amino acid sequence of SEQ ID NO:366 and a second light chain comprising the amino acid sequence of SEQ ID NO:367

(Molecule 11G). In one aspect, the bispecific agonistic CD28 antigen binding molecule comprises a first light chain comprising the amino acid sequence of SEQ ID NO:361, a first heavy chain comprising the amino acid sequence of SEQ ID NO:360, a second heavy chain comprising the amino acid sequence of SEQ ID NO:368 and a second light chain comprising the amino acid sequence of SEQ ID NO:363 (Molecule 11H). In one aspect, the bispecific agonistic CD28 antigen binding molecule comprises a first light chain comprising the amino acid sequence of SEQ ID NO:372, a first heavy chain comprising the amino acid sequence of SEQ ID NO:371, a second heavy chain comprising the amino acid sequence of SEQ ID NO:368 and a second light chain comprising the amino acid sequence of SEQ ID NO:363 (Molecule 11M). In one aspect, the bispecific agonistic CD28 antigen binding molecule comprises a first light chain comprising the amino acid sequence of SEQ ID NO:372, a first heavy chain comprising the amino acid sequence of SEQ ID NO:371, a second heavy chain comprising the amino acid sequence of SEQ ID NO:366 and a second light chain comprising the amino acid sequence of SEQ ID NO:367 (Molecule 11N). In one aspect, the bispecific agonistic CD28 antigen binding molecule comprises a first light chain comprising the amino acid sequence of SEQ ID NO:372, a first heavy chain comprising the amino acid sequence of SEQ ID NO:371, a second heavy chain comprising the amino acid sequence of SEQ ID NO:364 and a second light chain comprising the amino acid sequence of SEQ ID NO:365 (Molecule 11O).

In one aspect, provided is a bispecific agonistic CD28 antigen binding molecule as described herein, comprising
(a) one Fab fragment capable of specific binding to CD28,
(b) one crossFab fragment capable of specific binding to EpCAM, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28 comprising
(i) a heavy chain variable region ($V_1CD28$) comprising the amino acid sequence of SEQ ID NO:47 and a light chain variable region ($V_LCD28$) comprising the amino acid sequence of SEQ ID NO:54, or
(ii) a heavy chain variable region ($V_HCD28$) comprising the amino acid sequence of SEQ ID NO:46 and a light chain variable region ($V_LCD28$) comprising the amino acid sequence of SEQ ID NO:53, or
(iii) a heavy chain variable region ($V_HCD28$) comprising the amino acid sequence of SEQ ID NO:42 and a light chain variable region ($V_LCD28$) comprising the amino acid sequence of SEQ ID NO:27,
(b) one crossFab fragment capable of specific binding to EpCAM comprising a heavy chain variable region ($V_HEpCAM$) comprising the amino acid sequence of SEQ ID NO:521 and a light chain variable region ($V_LEpCAM$) comprising the amino acid sequence of SEQ ID NO:522,
and (c) a Fe domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28,
(b) one Fab fragment capable of specific binding to EpCAM, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one crossFab fragment capable of specific binding to CD28 comprising
(i) a heavy chain variable region ($V_HCD28$) comprising the amino acid sequence of SEQ ID NO:47 and a light chain variable region ($V_LCD28$) comprising the amino acid sequence of SEQ ID NO:54, or
(ii) a heavy chain variable region ($V_HCD28$) comprising the amino acid sequence of SEQ ID NO:46 and a light chain variable region ($V_LCD28$) comprising the amino acid sequence of SEQ ID NO:53, or
(iii) a heavy chain variable region ($V_HCD28$) comprising the amino acid sequence of SEQ ID NO:42 and a light chain variable region ($V_LCD28$) comprising the amino acid sequence of SEQ ID NO:27,
(b) one Fab fragment capable of specific binding to EpCAM comprising a heavy chain variable region ($V_HEpCAM$) comprising the amino acid sequence of SEQ ID NO:521 and a light chain variable region ($V_LEpCAM$) comprising the amino acid sequence of SEQ ID NO:522,
and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:367, a first heavy chain comprising the amino acid sequence of SEQ ID NO:366, a second heavy chain comprising the amino acid sequence of SEQ ID NO:390 and a second light chain comprising the amino acid sequence of SEQ ID NO:391 (Molecule 14A).

In one aspect, provided is a bispecific agonistic CD28 antigen binding molecule as described herein, comprising
(a) one Fab fragment capable of specific binding to CD28,
(b) one crossFab fragment capable of specific binding to HER3, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28 comprising
(i) a heavy chain variable region ($V_HCD28$) comprising the amino acid sequence of SEQ ID NO:47 and a light chain variable region ($V_LCD28$) comprising the amino acid sequence of SEQ ID NO:54, or
(ii) a heavy chain variable region ($V_HCD28$) comprising the amino acid sequence of SEQ ID NO:46 and a light chain variable region ($V_LCD28$) comprising the amino acid sequence of SEQ ID NO:53, or (iii) a heavy chain variable region (V$_H$CD28) comprising the amino acid sequence of SEQ ID NO:42 and a light chain variable region (V$_L$CD28) comprising the amino acid sequence of SEQ ID NO:27, (b) one crossFab fragment capable of specific binding to HER3 comprising a heavy chain variable region (V$_H$HER3) comprising the amino acid sequence of SEQ ID NO:529 and a light chain variable region (V$_L$HER3) comprising the amino acid sequence of SEQ ID NO:530, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:357, a first heavy chain comprising the amino acid sequence of SEQ ID NO:358, a second heavy chain comprising the amino acid sequence of SEQ ID NO:392 and a second light chain comprising the amino acid sequence of SEQ ID NO:393 (Molecule 14B).

In one aspect, provided is a bispecific agonistic CD28 antigen binding molecule as described herein, comprising
(a) one crossFab fragment capable of specific binding to CD28,
(b) one Fab fragment capable of specific binding to HER3, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one crossFab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one Fab fragment capable of specific binding to HER3 comprising a heavy chain variable region (V$_H$HER3) comprising the amino acid sequence of SEQ ID NO:529 and a light chain variable region (V$_L$HER3) comprising the amino acid sequence of SEQ ID NO:530, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28,
(b) one crossFab fragment capable of specific binding to CD30, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one Fab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one crossFab fragment capable of specific binding to CD30 comprising a heavy chain variable region (V$_H$CD30) comprising the amino acid sequence of SEQ ID NO:537 and a light chain variable region (V$_L$CD30) comprising the amino acid sequence of SEQ ID NO:538, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:357, a first heavy chain comprising the amino acid sequence of SEQ ID NO:358, a second heavy chain comprising the amino acid sequence of SEQ ID NO:394 and a second light chain comprising the amino acid sequence of SEQ ID NO:395 (Molecule 14C).

In one aspect, provided is a bispecific agonistic CD28 antigen binding molecule as described herein, comprising
(a) one crossFab fragment capable of specific binding to CD28,
(b) one Fab fragment capable of specific binding to CD30, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising
(a) one crossFab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one Fab fragment capable of specific binding to CD30 comprising a heavy chain variable region (V$_H$CD30) comprising the amino acid sequence of SEQ ID NO:537 and a light chain variable region (V$_L$CD30) comprising the amino acid sequence of SEQ ID NO:538, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28,
(b) one crossFab fragment capable of specific binding to TPBG, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one crossFab fragment capable of specific binding to TPBG comprising a heavy chain variable region (V$_L$TPBG) comprising the amino acid sequence of SEQ ID NO:545 and a light chain variable region (V$_L$TPBG) comprising the amino acid sequence of SEQ ID NO:546, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:357, a first heavy chain comprising the amino acid sequence of SEQ ID NO:358, a second heavy chain comprising the amino acid sequence of SEQ ID NO:396 and a second light chain comprising the amino acid sequence of SEQ ID NO:397 (Molecule 14D).

In one aspect, provided is a bispecific agonistic CD28 antigen binding molecule as described herein, comprising (a) one crossFab fragment capable of specific binding to CD28,
(b) one Fab fragment capable of specific binding to TPBG, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one Fab fragment capable of specific binding to TPBG comprising a heavy chain variable region (V$_H$TPBG) comprising the amino acid sequence of SEQ ID NO:545 and a light chain variable region (V$_L$TPBG) comprising the amino acid sequence of SEQ ID NO:546, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28,
(b) one crossFab fragment capable of specific binding to CD38, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising
(i) a heavy chain variable region (V$_H$CD28) comprising the amino acid sequence of SEQ ID NO:47 and a light chain variable region (V$_L$CD28) comprising the amino acid sequence of SEQ ID NO:54, or
(ii) a heavy chain variable region (V$_H$CD28) comprising the amino acid sequence of SEQ ID NO:46 and a light chain variable region (V$_L$CD28) comprising the amino acid sequence of SEQ ID NO:53, or
(iii) a heavy chain variable region (V$_H$CD28) comprising the amino acid sequence of SEQ ID NO:42 and a light chain variable region (V$_L$CD28) comprising the amino acid sequence of SEQ ID NO:27,
(b) one crossFab fragment capable of specific binding to CD38 comprising a heavy chain variable region (V$_H$CD38) comprising the amino acid sequence of SEQ ID NO:553 and a light chain variable region (V$_L$CD38) comprising the amino acid sequence of SEQ ID NO:554, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:357, a first heavy chain comprising the amino acid sequence of SEQ ID NO:358, a second heavy chain comprising the amino acid sequence of SEQ ID NO:400 and a second light chain comprising the amino acid sequence of SEQ ID NO:401 (Molecule 16C).

In one aspect, provided is a bispecific agonistic CD28 antigen binding molecule as described herein, comprising (a) one crossFab fragment capable of specific binding to CD28, (b) one Fab fragment capable of specific binding to CD38, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising (i) a heavy chain variable region ($V_H$CD28) comprising the amino acid sequence of SEQ ID NO:47 and a light chain variable region ($V_L$CD28) comprising the amino acid sequence of SEQ ID NO:54, or (ii) a heavy chain variable region ($V_H$CD28) comprising the amino acid sequence of SEQ ID NO:46 and a light chain variable region ($V_L$CD28) comprising the amino acid sequence of SEQ ID NO:53, or (iii) a heavy chain variable region ($V_H$CD28) comprising the amino acid sequence of SEQ ID NO:42 and a light chain variable region ($V_L$CD28) comprising the amino acid sequence of SEQ ID NO:27, (b) one Fab fragment capable of specific binding to CD38 comprising a heavy chain variable region ($V_H$CD38) comprising the amino acid sequence of SEQ ID NO:553 and a light chain variable region ($V_L$CD38) comprising the amino acid sequence of SEQ ID NO:554, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28, (b) one crossFab fragment capable of specific binding to BCMA, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising (i) a heavy chain variable region ($V_H$CD28) comprising the amino acid sequence of SEQ ID NO:47 and a light chain variable region ($V_L$CD28) comprising the amino acid sequence of SEQ ID NO:54, or (ii) a heavy chain variable region ($V_H$CD28) comprising the amino acid sequence of SEQ ID NO:46 and a light chain variable region ($V_L$CD28) comprising the amino acid sequence of SEQ ID NO:53, or (iii) a heavy chain variable region ($V_H$CD28) comprising the amino acid sequence of SEQ ID NO:42 and a light chain variable region ($V_L$CD28) comprising the amino acid sequence of SEQ ID NO:27, (b) one crossFab fragment capable of specific binding to BCMA comprising a heavy chain variable region ($V_H$BCMA) comprising the amino acid sequence of SEQ ID NO:561 and a light chain variable region ($V_L$BCMA) comprising the amino acid sequence of SEQ ID NO:562, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28, (b) one Fab fragment capable of specific binding to BCMA, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising (i) a heavy chain variable region ($V_H$CD28) comprising the amino acid sequence of SEQ ID NO:47 and a light chain variable region ($V_L$CD28) comprising the amino acid sequence of SEQ ID NO:54, or (ii) a heavy chain variable region ($V_H$CD28) comprising the amino acid sequence of SEQ ID NO:46 and a light chain variable region ($V_L$CD28) comprising the amino acid sequence of SEQ ID NO:53, or (iii) a heavy chain variable region ($V_H$CD28) comprising the amino acid sequence of SEQ ID NO:42 and a light chain variable region ($V_L$CD28) comprising the amino acid sequence of SEQ ID NO:27, (b) one Fab fragment capable of specific binding to BCMA comprising a heavy chain variable region ($V_L$BCMA) comprising the amino acid sequence of SEQ ID NO:561 and a light chain variable region ($V_L$BCMA) comprising the amino acid sequence of SEQ ID NO:562, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:367, a first heavy chain comprising the amino acid sequence of SEQ ID NO:366, a second heavy chain comprising the amino acid sequence of SEQ ID NO:402 and a second light chain comprising the amino acid sequence of SEQ ID NO:403 (Molecule 16D).

In one aspect, provided is a bispecific agonistic CD28 antigen binding molecule as described herein, comprising (a) one Fab fragment capable of specific binding to CD28, (b) one crossFab fragment capable of specific binding to GPRC5D, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising (i) a heavy chain variable region ($V_H$CD28) comprising the amino acid sequence of SEQ ID NO:47 and a light chain variable region (V$_L$CD28) comprising the amino acid sequence of SEQ ID NO:54, or (ii) a heavy chain variable region (V$_H$CD28) comprising the amino acid sequence of SEQ ID NO:46 and a light chain variable region (V$_L$CD28) comprising the amino acid sequence of SEQ ID NO:53, or (iii) a heavy chain variable region (V$_H$CD28) comprising the amino acid sequence of SEQ ID NO:42 and a light chain variable region (V$_L$CD28) comprising the amino acid sequence of SEQ ID NO:27, (b) one crossFab fragment capable of specific binding to GPRC5D comprising a heavy chain variable region (V$_H$GPRC5D) comprising the amino acid sequence of SEQ ID NO:569 and a light chain variable region (V$_L$GPRC5D) comprising the amino acid sequence of SEQ ID NO:570, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:365, a first heavy chain comprising the amino acid sequence of SEQ ID NO:364, a second heavy chain comprising the amino acid sequence of SEQ ID NO:398 and a second light chain comprising the amino acid sequence of SEQ ID NO:399 (Molecule 16B).

In one aspect, provided is a bispecific agonistic CD28 antigen binding molecule as described herein, comprising (a) one crossFab fragment capable of specific binding to CD28, (b) one Fab fragment capable of specific binding to GPRC5D, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising (i) a heavy chain variable region (V$_H$CD28) comprising the amino acid sequence of SEQ ID NO:47 and a light chain variable region (V$_L$CD28) comprising the amino acid sequence of SEQ ID NO:54, or (ii) a heavy chain variable region (V$_H$CD28) comprising the amino acid sequence of SEQ ID NO:46 and a light chain variable region (V$_L$CD28) comprising the amino acid sequence of SEQ ID NO:53, or (iii) a heavy chain variable region (V$_H$CD28) comprising the amino acid sequence of SEQ ID NO:42 and a light chain variable region (V$_L$CD28) comprising the amino acid sequence of SEQ ID NO:27, (b) one Fab fragment capable of specific binding to GPRC5D comprising a heavy chain variable region (V$_H$GPRC5D) comprising the amino acid sequence of SEQ ID NO:569 and a light chain variable region (V$_L$GPRC5D) comprising the amino acid sequence of SEQ ID NO:570, and (c) a Fc domain composed of a first and a second subunit capable of stable association comprising one or more amino acid substitution that reduces the binding affinity of the antigen binding molecule to an Fc receptor and/or effector function.

In one aspect, the bispecific agonistic CD28 antigen binding molecule comprises a first light chain comprising the amino acid sequence of SEQ ID NO:367, a first heavy chain comprising the amino acid sequence of SEQ ID NO:366, a second heavy chain comprising the amino acid sequence of SEQ ID NO:398 and a second light chain comprising the amino acid sequence of SEQ ID NO:399 (Molecule 16A).

Bispecific Agonistic CD28 Antigen Binding Molecules Monovalent for Binding to CD28 and Bivalent for Binding to the Tumor-Associated Antigen (1+2 Format)

In another aspect, a bispecific agonistic CD28 antigen binding molecule as disclosed herein is provided, comprising (a) a first Fab fragment capable of specific binding to CD28, (b) a second and a third Fab fragment capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

In one particular aspect, provided is a bispecific agonistic CD28 antigen binding molecule comprising two light chains, each comprising the amino acid sequence of SEQ ID NO:78, one light chain comprising the amino acid sequence of SEQ ID NO:77, a first heavy chain comprising the amino acid sequence of SEQ ID NO:75, and a second heavy chain comprising the amino acid sequence of SEQ ID NO:76 (Molecule G).

In one aspect, provided is a bispecific agonistic CD28 antigen binding molecule as described herein, comprising (a) a first crossFab fragment capable of specific binding to CD28 comprising (i) a heavy chain variable region (V$_H$CD28) comprising the amino acid sequence of SEQ ID NO:47 and a light chain variable region (V$_L$CD28) comprising the amino acid sequence of SEQ ID NO:54, or (ii) a heavy chain variable region (V$_H$CD28) comprising the amino acid sequence of SEQ ID NO:46 and a light chain variable region (V$_L$CD28) comprising the amino acid sequence of SEQ ID NO:53, or (iii) a heavy chain variable region (V$_H$CD28) comprising the amino acid sequence of SEQ ID NO:42 and a light chain variable region (V$_L$CD28) comprising the amino acid sequence of SEQ ID NO:27, (b) a second and a third Fab fragment capable of specific binding to fragment capable of specific binding to CEA comprising (i) a heavy chain variable region (V$_H$CEA) comprising the amino acid sequence of SEQ ID NO:186 and a light chain variable region (V$_L$CEA) comprising the amino acid sequence of SEQ ID NO:187, or (ii) a heavy chain variable region (V$_H$CEA) comprising the amino acid sequence of SEQ ID NO:200 and a light chain variable region (V$_L$CEA) comprising the amino acid sequence of SEQ ID NO:201, or (iii) a heavy chain variable region (V$_H$CEA) comprising the amino acid sequence of SEQ ID NO:513 and a light chain variable region (V$_L$CEA) comprising the amino acid sequence of SEQ ID NO:514, and (c) a Fc domain composed of a first and a second subunit capable of stable association comprising one or more amino acid substitution that reduces the binding affinity of the antigen binding molecule to an Fc receptor and/or effector function.

In one particular aspect, provided is a bispecific agonistic CD28 antigen binding molecule comprising two light chains, each comprising the amino acid sequence of SEQ ID NO:361, one light chain comprising the amino acid sequence of SEQ ID NO:368, a first heavy chain comprising the amino acid sequence of SEQ ID NO:362, and a second heavy chain comprising the amino acid sequence of SEQ ID NO:373 (Molecule 11P).

In one particular aspect, provided is a bispecific agonistic CD28 antigen binding molecule comprising two light chains, each comprising the amino acid sequence of SEQ ID NO:361, one light chain comprising the amino acid sequence of SEQ ID NO:368, a first heavy chain comprising the amino acid sequence of SEQ ID NO:360, and a second heavy chain comprising the amino acid sequence of SEQ ID NO:374 (Molecule 11Q).

FAP- and CEA-Targeting Agonistic CD28 Antigen Binding Molecules

Herein provided is also a bispecific agonistic CD28 antigen binding molecule with monovalent binding to CD28, comprising
(a) one antigen binding domains capable of specific binding to CD28,
(b) one antigen binding domain capable of specific binding to a first tumor-associated antigen, and
(c) an Fc domain composed of a first and a second subunit capable of stable association comprising one or more amino acid substitution that reduces the binding affinity of the antigen binding molecule to an Fc receptor and/or effector function, characterized in that it additionally comprises one antigen binding domain capable of specific binding to a second tumor-associated antigen.

In one particular aspect, provided is a trispecific agonistic CD28 antigen binding molecule with monovalent binding to CD28, comprising
(a) one antigen binding domains capable of specific binding to CD28,
(b) one antigen binding domain capable of specific binding to CEA and one antigen binding domain capable of specific binding to FAP,
(c) an Fc domain composed of a first and a second subunit capable of stable association comprising one or more amino acid substitution that reduces the binding affinity of the antigen binding molecule to an Fc receptor and/or effector function.

In one particular aspect, provided is a bispecific agonistic CD28 antigen binding molecule comprising a first light chain comprising the amino acid sequence of SEQ ID NO:88, a first heavy chain comprising the amino acid sequence of SEQ ID NO:87, a second heavy chain comprising the amino acid sequence of SEQ ID NO:388 and a second light chain comprising the amino acid sequence of SEQ ID NO:389 (Molecule Y).

B Cell Surface Antigen-Targeting Bispecific Agonistic CD28 Antigen Binding Molecules The invention provides novel bispecific agonistic CD28 antigen binding molecules with particularly advantageous properties such as producibility, stability, binding affinity, biological activity, targeting efficiency, reduced toxicity, an extended dosage range that can be given to a patient and thereby a possibly enhanced efficacy. The novel bispecific agonistic CD28 antigen binding molecules comprise an Fc domain composed of a first and a second subunit capable of stable association comprising one or more amino acid substitution that reduces the binding affinity of the antigen binding molecule to an Fc receptor and/or effector function (Fc silent) and thus unspecific cross-linking via Fc receptors is avoided. Instead, they comprise at least one antigen binding domain capable of specific binding to a B cell surface antigen such as CD19 or CD79b which causes cross-linking in the presence of CD19- or CD79b-expressing B cells. Thus, specific T cell activation in the presence of CD19- or CD79b-expressing B cells is achieved.

Herein provided is a bispecific agonistic CD28 antigen binding molecule comprising an antigen binding domain capable of specific binding to CD28, an antigen binding domain capable of specific binding to a B cell surface antigen, and a Fc domain composed of a first and a second subunit capable of stable association comprising one or more amino acid substitution that reduces the binding affinity of the antigen binding molecule to an Fc receptor and/or effector function. In one aspect, the bispecific agonistic CD28 antigen binding molecule as described herein is characterized by monovalent binding to CD28. In a further aspect, the bispecific agonistic CD28 antigen binding molecule as described herein is characterized by monovalent binding to the B cell surface antigen.

In one aspect, a bispecific agonistic CD28 antigen binding molecule as defined herein before is provided, wherein the Fc domain is an IgG, particularly an IgG1 Fc domain or an IgG4 Fc domain. In one particular aspect, the Fc domain composed of a first and a second subunit capable of stable association is an IgG1 Fc domain. The Fc domain comprises one or more amino acid substitution that reduces the binding affinity of the antigen binding molecule to an Fc receptor and/or reduces or abolishes effector function. In one aspect, the Fc domain comprises the amino acid substitutions L234A and L235A (numbering according to Kabat EU index). In one aspect, the Fc domain is of human IgG1 subclass and comprises the amino acid mutations L234A, L235A and P329G (numbering according to Kabat EU index).

In one aspect, provided is a bispecific agonistic CD28 antigen binding molecule as defined herein before, wherein the antigen binding domain capable of specific binding to CD28 comprises
(i) a heavy chain variable region (V$_H$CD28) comprising a heavy chain complementary determining region CDR-H1 of SEQ ID NO: 20, a CDR-H2 of SEQ ID NO: 21, and a CDR-H3 of SEQ ID NO: 22, and a light chain variable region (V$_L$CD28) comprising a light chain complementary determining region CDR-L1 of SEQ ID NO: 23, a CDR-L2 of SEQ ID NO: 24 and a CDR-L3 of SEQ ID NO: 25; or
(ii) a heavy chain variable region (V$_H$CD28) comprising a CDR-H1 of SEQ ID NO: 36, a CDR-H2 of SEQ ID NO: 37, and a CDR-H3 of SEQ ID NO: 38, and a light chain variable region (V$_L$CD28) comprising a CDR-L1 of SEQ ID NO: 39, a CDR-L2 of SEQ ID NO: 40 and a CDR-L3 of SEQ ID NO: 41.

In one aspect, the antigen binding domain capable of specific binding to CD28 of the bispecific agonistic CD28 antigen binding molecule comprises a heavy chain variable region (V$_H$CD28) comprising a CDR-H1 of SEQ ID NO:20, a CDR-H2 of SEQ ID NO:21, and a CDR-H3 of SEQ ID NO:22, and a light chain variable region (V$_L$CD28) comprising a CDR-L1 of SEQ ID NO:23, a CDR-L2 of SEQ ID NO:24 and a CDR-L3 of SEQ ID NO:25. In one aspect, provided is a bispecific agonistic CD28 antigen binding molecule as defined herein before, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:26, and a light chain variable region ($V_L$CD28) comprising an amino acid sequence that is at least about 95%, 96%, 97%, 98%, 99% or 100% identical to the amino acid sequence of SEQ ID NO:27. In one aspect, the antigen binding domain capable of specific binding to CD28 comprises a heavy chain variable region ($V_H$CD28) comprising the amino acid sequence of SEQ ID NO:26 and a light chain variable region ($V_L$CD28) comprising the amino acid sequence of SEQ ID NO:27.

In another aspect, the antigen binding domain capable of specific binding to CD28 of the bispecific agonistic CD28 antigen binding molecule comprises a heavy chain variable region ($V_H$CD28) comprising a CDR-H1 of SEQ ID NO: 28, a CDR-H2 of SEQ ID NO: 29, and a CDR-H3 of SEQ ID NO: 30, and a light chain variable region ($V_L$CD28) comprising a CDR-L1 of SEQ ID NO: 31, a CDR-L2 of SEQ ID NO:32 and a CDR-L3 of SEQ ID NO:33. In one aspect, provided is a bispecific agonistic CD28 antigen binding molecule as defined herein before, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:34, and a light chain variable region ($V_L$CD28) comprising an amino acid sequence that is at least about 95%, 96%, 97%, 98%, 99% or 100% identical to the amino acid sequence of SEQ ID NO:35. In one aspect, the antigen binding domain capable of specific binding to CD28 comprises a heavy chain variable region ($V_H$CD28) comprising the amino acid sequence of SEQ ID NO:34 and a light chain variable region ($V_L$CD28) comprising the amino acid sequence of SEQ ID NO:35.

In another aspect, the antigen binding domain capable of specific binding to CD28 of the bispecific agonistic CD28 antigen binding molecule comprises a heavy chain variable region ($V_H$CD28) comprising a CDR-H1 of SEQ ID NO: 36, a CDR-H2 of SEQ ID NO: 37, and a CDR-H3 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

In a further aspect, a bispecific agonistic CD28 antigen binding molecule is provided, wherein the antigen binding domain capable of specific binding to CD28 comprises a heavy chain variable region ($V_H$CD28) comprising an amino acid sequence selected from the group consisting of SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50 and SEQ ID NO:51, and a light chain variable region ($V_L$CD28) comprising an amino acid sequence selected from the group consisting of SEQ ID NO:27, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60 and SEQ ID NO:61.

In another aspect, provided is bispecific agonistic CD28 antigen binding molecule, wherein the antigen binding domain capable of specific binding to CD28 comprises (a) a heavy chain variable region ($V_H$CD28) comprising the amino acid sequence of SEQ ID NO:47 and a light chain variable region ($V_L$CD28) comprising the amino acid sequence of SEQ ID NO:54, or (b) a heavy chain variable region ($V_H$CD28) comprising the amino acid sequence of SEQ ID NO:47 and a light chain variable region ($V_L$CD28) comprising the amino acid sequence of SEQ ID NO:27, or (c) a heavy chain variable region ($V_H$CD28) comprising the amino acid sequence of SEQ ID NO:51 and a light chain variable region ($V_L$CD28) comprising the amino acid sequence of SEQ ID NO:61, or (d) a heavy chain variable region ($V_H$CD28) comprising the amino acid sequence of SEQ ID NO:46 and a light chain variable region ($V_L$CD28) comprising the amino acid sequence of SEQ ID NO:53, or (e) a heavy chain variable region ($V_H$CD28) comprising the amino acid sequence of SEQ ID NO:46 and a light chain variable region ($V_L$CD28) comprising the amino acid sequence of SEQ ID NO:54, or (f) a heavy chain variable region ($V_H$CD28) comprising the amino acid sequence of SEQ ID NO:46 and a light chain variable region ($V_L$CD28) comprising the amino acid sequence of SEQ ID NO:59, or (g) a heavy chain variable region ($V_H$CD28) comprising the amino acid sequence of SEQ ID NO:46 and a light chain variable region ($V_L$CD28) comprising the amino acid sequence of SEQ ID NO:27, or (h) a heavy chain variable region ($V_H$CD28) comprising the amino acid sequence of SEQ ID NO:43 and a light chain variable region ($V_L$CD28) comprising the amino acid sequence of SEQ ID NO:27, or (i) a heavy chain variable region ($V_H$CD28) comprising the amino acid sequence of SEQ ID NO:42 and a light chain variable region ($V_L$CD28) comprising the amino acid sequence of SEQ ID NO:53, or (j) a heavy chain variable region ($V_H$CD28) comprising the amino acid sequence of SEQ ID NO:42 and a light chain variable region ($V_L$CD28) comprising the amino acid sequence of SEQ ID NO:59, or (k) a heavy chain variable region ($V_H$CD28) comprising the amino acid sequence of SEQ ID NO:42 and a light chain variable region ($V_L$CD28) comprising the amino acid sequence of SEQ ID NO:27.

In one aspect, the bispecific agonistic CD28 antigen binding molecule comprises an antigen binding domain capable of specific binding to CD28 comprising a heavy chain variable region ($V_H$CD28) comprising the amino acid sequence of SEQ ID NO:46 and a light chain variable region ($V_L$CD28) comprising the amino acid sequence of SEQ ID NO:53, or a heavy chain variable region ($V_H$CD28) comprising the amino acid sequence of SEQ ID NO:47 and a light chain variable region ($V_L$CD28) comprising the amino acid sequence of SEQ ID NO:54, or a heavy chain variable region ($V_H$CD28) comprising the amino acid sequence of SEQ ID NO:47 and a light chain variable region ($V_L$CD28) comprising the amino acid sequence of SEQ ID NO:27, or a heavy chain variable region ($V_H$CD28) comprising the amino acid sequence of SEQ ID NO:42 and a light chain variable region ($V_L$CD28) comprising the amino acid sequence of SEQ ID NO:27. In one particular aspect, a bispecific agonistic CD28 antigen binding molecule is provided, wherein the antigen binding domain capable of specific binding to CD28 comprises a heavy chain variable region ($V_H$CD28) comprising the amino acid sequence of SEQ ID NO:46 and a light chain variable region ($V_L$CD28) comprising the amino acid sequence of SEQ ID NO:53. In another particular aspect, a bispecific agonistic CD28 antigen binding molecule is provided, wherein the antigen binding domain capable of specific binding to CD28 comprises a heavy chain variable region ($V_H$CD28) comprising the amino acid sequence of SEQ ID NO:47 and a light chain variable region ($V_L$CD28) comprising the amino acid sequence of SEQ ID NO:54. In further particular aspect, a bispecific agonistic CD28 antigen binding molecule is provided, wherein the antigen binding domain capable of specific binding to CD28 comprises a heavy chain variable region ($V_H$CD28) comprising the amino acid sequence of SEQ ID NO:47 and a light chain variable region ($V_L$CD28) comprising the amino acid sequence of SEQ ID NO:27. In yet another particular aspect, a bispecific agonistic CD28 antigen binding molecule is provided, wherein the antigen binding domain capable of specific binding to CD28 comprises a heavy chain variable region ($V_H$CD28) comprising the amino acid sequence of SEQ ID NO:42 and a light chain variable region ($V_L$CD28) comprising the amino acid sequence of SEQ ID In one aspect, a bispecific agonistic CD28 antigen binding molecule is provided, wherein the antigen binding domain capable of specific binding to B cell surface antigen is an antigen binding domain capable of specific binding to CD19.

In one aspect, provided is a bispecific agonistic CD28 antigen binding molecule as described herein, wherein the antigen binding domain capable of specific binding to CD19 comprises (a) a heavy chain variable region ($V_H$CD19) comprising (i) CDR-H1 comprising the amino acid sequence of SEQ ID NO:406, (ii) CDR-H2 comprising the amino acid sequence of SEQ ID NO:407, and (iii) CDR-H3 comprising the amino acid sequence of SEQ ID NO:408, and a light chain variable region ($V_L$CD19) comprising (iv) CDR-L1 comprising the amino acid sequence of SEQ ID NO:409, (v) CDR-L2 comprising the amino acid sequence of SEQ ID NO:410, and (vi) CDR-L3 comprising the amino acid sequence of SEQ ID NO:411, or (b) a heavy chain variable region ($V_H$CD19) comprising (i) CDR-H1 comprising the amino acid sequence of SEQ ID NO:414, (ii) CDR-H2 comprising the amino acid sequence of SEQ ID NO:415, and (iii) CDR-H3 comprising the amino acid sequence of SEQ ID NO:416, and a light chain variable region ($V_L$CD19) comprising (iv) CDR-L1 comprising the amino acid sequence of SEQ ID NO:417, (v) CDR-L2 comprising the amino acid sequence of SEQ ID NO:418, and (vi) CDR-L3 comprising the amino acid sequence of SEQ ID NO:419. Particularly, the antigen binding domain capable of specific binding to CD19 comprises (a) a heavy chain variable region ($V_H$CD19) comprising an amino acid sequence that is at least about 95%, 98% or 100% identical to the amino acid sequence of SEQ ID NO:412, and a light chain variable region ($V_L$CD19) comprising an amino acid sequence that is at least about 95%, 98% or 100% identical to the amino acid sequence of SEQ ID NO:413, or (b) a heavy chain variable region ($V_H$CD19) comprising an amino acid sequence that is at least about 95%, 98% or 100% identical to the amino acid sequence of SEQ ID NO:420, and a light chain variable region ($V_L$CD19) comprising an amino acid sequence that is at least about 95%, 98% or 100% identical to the amino acid sequence of SEQ ID NO:421. In one particular aspect, the antigen binding domain capable of specific binding to CD19 comprises a heavy chain variable region ($V_H$CD19) comprising an amino acid sequence of SEQ ID NO:412 and a light chain variable region ($V_L$CD19) comprising an amino acid sequence of SEQ ID NO:413.

In another aspect, a bispecific agonistic CD28 antigen binding molecule is provided, wherein the antigen binding domain capable of specific binding to a B cell surface antigen is an antigen binding domain capable of specific binding to CD79b.

In one aspect, provided is a bispecific agonistic CD28 antigen binding molecule as described herein, wherein the antigen binding domain capable of specific binding to CD79b comprises a heavy chain variable region ($V_H$CD79b) comprising (i) CDR-H1 comprising the amino acid sequence of SEQ ID NO:422, (ii) CDR-H2 comprising the amino acid sequence of SEQ ID NO:423, and (iii) CDR-H3 comprising the amino acid sequence of SEQ ID NO:424, and a light chain variable region ($V_L$CD79b) comprising (iv) CDR-L1 comprising the amino acid sequence of SEQ ID NO:425, (v) CDR-L2 comprising the amino acid sequence of SEQ ID NO:426, and (vi) CDR-L3 comprising the amino acid sequence of SEQ ID NO:427. In particular, the antigen binding domain capable of specific binding to CD79b comprises a heavy chain variable region ($V_H$CD79b) comprising an amino acid sequence that is at least about 95%, 98%, or 100% identical to the amino acid sequence of SEQ ID NO:428, and a light chain variable region ($V_L$CD79b) comprising an amino acid sequence that is at least about 95%, 98% or 100% identical to the amino acid sequence of SEQ ID NO:429. In one aspect, the antigen binding domain capable of specific binding to CD79b comprises a heavy chain variable region ($V_H$CD79b) comprising the amino acid sequence of SEQ ID NO:428, and a light chain variable region ($V_L$CD79b) comprising the amino acid sequence of SEQ ID NO:429.

In a further aspect, provided is a bispecific agonistic CD28 antigen binding molecule as defined herein before, wherein the antigen binding domain capable of specific binding to CD28 is a Fab fragment or a crossFab fragment. In one particular aspect, the antigen binding domain capable of specific binding to CD28 is a Fab fragment and the antigen binding domain capable of specific binding to a B cell surface antigen is a crossFab fragment.

Bispecific Agonistic CD28 Antigen Binding Molecules Monovalent for Binding to CD28 and Monovalent for Binding to a B Cell Surface Antigen (1+1 Format)

In another aspect, provided is a bispecific agonistic CD28 antigen binding molecule as described herein, comprising (a) one Fab fragment capable of specific binding to CD28,
(b) one crossFab fragment capable of specific binding to a B cell surface antigen, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28,
(b) one crossFab fragment capable of specific binding to CD19, and
(c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising
(i) a heavy chain variable region ($V_H$CD28) comprising the amino acid sequence of SEQ ID NO:47 and a light chain variable region (V<sub>L</sub>CD28) comprising the amino acid sequence of SEQ ID NO:54, or (ii) a heavy chain variable region (V<sub>H</sub>CD28) comprising the amino acid sequence of SEQ ID NO:46 and a light chain variable region (V<sub>L</sub>CD28) comprising the amino acid sequence of SEQ ID NO:53, or (iii) a heavy chain variable region (V<sub>H</sub>CD28) comprising the amino acid sequence of SEQ ID NO:42 and a light chain variable region (V<sub>L</sub>CD28) comprising the amino acid sequence of SEQ ID NO:27, (b) one crossFab fragment capable of specific binding to CD19 comprising (i) a heavy chain variable region (V<sub>H</sub>CD19) comprising the amino acid sequence of SEQ ID NO:412 and a light chain variable region (V<sub>L</sub>CD19) comprising the amino acid sequence of SEQ ID NO:413, or (ii) a heavy chain variable region (V1 CD19) comprising the amino acid sequence of SEQ ID NO:420 and a light chain variable region (V<sub>L</sub>CD19) comprising the amino acid sequence of SEQ ID NO:421, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule comprising a first light chain comprising the amino acid sequence of SEQ ID NO:65, a first heavy chain comprising the amino acid sequence of SEQ ID NO:118, a second heavy chain comprising the amino acid sequence of SEQ ID NO:430 and a second light chain comprising the amino acid sequence of SEQ ID NO:431 (Molecule 18A).

In one particular aspect, provided is a bispecific agonistic CD28 antigen binding molecule comprising a first light chain comprising the amino acid sequence of SEQ ID NO:121, a first heavy chain comprising the amino acid sequence of SEQ ID NO:116, a second heavy chain comprising the amino acid sequence of SEQ ID NO:430 and a second light chain comprising the amino acid sequence of SEQ ID NO:431 (Molecule 18B).

In another particular aspect, provided is a bispecific agonistic CD28 antigen binding molecule comprising a first light chain comprising the amino acid sequence of SEQ ID NO:122, a first heavy chain comprising the amino acid sequence of SEQ ID NO:114, a second heavy chain comprising the amino acid sequence of SEQ ID NO:430 and a second light chain comprising the amino acid sequence of SEQ ID NO:431 (Molecule 18C).

In one further aspect, provided is a bispecific agonistic CD28 antigen binding molecule comprising a first light chain comprising the amino acid sequence of SEQ ID NO:65, a first heavy chain comprising the amino acid sequence of SEQ ID NO:114, a second heavy chain comprising the amino acid sequence of SEQ ID NO:430 and a second light chain comprising the amino acid sequence of SEQ ID NO:431 (Molecule 18D).

In yet another aspect, provided is a bispecific agonistic CD28 antigen binding molecule comprising a first light chain comprising the amino acid sequence of SEQ ID NO:123, a first heavy chain comprising the amino acid sequence of SEQ ID NO:118, a second heavy chain comprising the amino acid sequence of SEQ ID NO:430 and a second light chain comprising the amino acid sequence of SEQ ID NO:431 (Molecule 18E).

In another aspect, provided is a bispecific agonistic CD28 antigen binding molecule as described herein, comprising (a) one crossFab fragment capable of specific binding to CD28, (b) one Fab fragment capable of specific binding to CD19, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising (i) a heavy chain variable region (V<sub>H</sub>CD28) comprising the amino acid sequence of SEQ ID NO:47 and a light chain variable region (V<sub>L</sub>CD28) comprising the amino acid sequence of SEQ ID NO:54, or (ii) a heavy chain variable region (V<sub>H</sub>CD28) comprising the amino acid sequence of SEQ ID NO:46 and a light chain variable region (V<sub>L</sub>CD28) comprising the amino acid sequence of SEQ ID NO:53, or (iii) a heavy chain variable region (V<sub>H</sub>CD28) comprising the amino acid sequence of SEQ ID NO:42 and a light chain variable region (V<sub>L</sub>CD28) comprising the amino acid sequence of SEQ ID NO:27, (b) one Fab fragment capable of specific binding to CD19 comprising (i) a heavy chain variable region (V<sub>H</sub>CD19) comprising the amino acid sequence of SEQ ID NO:412 and a light chain variable region (V<sub>L</sub>CD19) comprising the amino acid sequence of SEQ ID NO:413, or (ii) a heavy chain variable region (V<sub>H</sub>CD19) comprising the amino acid sequence of SEQ ID NO:420 and a light chain variable region (V<sub>L</sub>CD19) comprising the amino acid sequence of SEQ ID NO:421, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28, (b) one crossFab fragment capable of specific binding to CD79b, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one Fab fragment capable of specific binding to CD28 comprising (i) a heavy chain variable region (V<sub>H</sub>CD28) comprising the amino acid sequence of SEQ ID NO:47 and a light chain variable region (V<sub>L</sub>CD28) comprising the amino acid sequence of SEQ ID NO:54, or (ii) a heavy chain variable region (V<sub>H</sub>CD28) comprising the amino acid sequence of SEQ ID NO:46 and a light chain variable region (V<sub>L</sub>CD28) comprising the amino acid sequence of SEQ ID NO:53, or (iii) a heavy chain variable region (V<sub>H</sub>CD28) comprising the amino acid sequence of SEQ ID NO:42 and a light chain variable region (V<sub>L</sub>CD28) comprising the amino acid sequence of SEQ ID NO:27, (b) one crossFab fragment capable of specific binding to CD79b comprising a heavy chain variable region ($V_H$CD79b) comprising the amino acid sequence of SEQ ID NO:428 and a light chain variable region ($V_L$CD79b) comprising the amino acid sequence of SEQ ID NO:429, and (c) a Fc domain composed of a first and a second subunit capable of stable association comprising one or more amino acid substitution that reduces the binding affinity of the antigen binding molecule to an Fc receptor and/or effector function.

In one particular aspect, provided is a bispecific agonistic CD28 antigen binding molecule comprising a first light chain comprising the amino acid sequence of SEQ ID NO:121, a first heavy chain comprising the amino acid sequence of SEQ ID NO:116, a second heavy chain comprising the amino acid sequence of SEQ ID NO:432 and a second light chain comprising the amino acid sequence of SEQ ID NO:433 (Molecule 18F).

In another aspect, provided is a bispecific agonistic CD28 antigen binding molecule as described herein, comprising (a) one crossFab fragment capable of specific binding to CD28, (b) one Fab fragment capable of specific binding to CD19, and (c) a Fc domain composed of a first and a second subunit capable of stable association comprising one or more amino acid substitution that reduces the binding affinity of the antigen binding molecule to an Fc receptor and/or effector function.

In one aspect, provided is a bispecific agonistic CD28 antigen binding molecule as described herein, comprising (a) one crossFab fragment capable of specific binding to CD28 comprising (i) a heavy chain variable region ($V_H$CD28) comprising the amino acid sequence of SEQ ID NO:47 and a light chain variable region ($V_L$CD28) comprising the amino acid sequence of SEQ ID NO:54, or (ii) a heavy chain variable region ($V_H$CD28) comprising the amino acid sequence of SEQ ID NO:46 and a light chain variable region ($V_L$CD28) comprising the amino acid sequence of SEQ ID NO:53, or (iii) a heavy chain variable region ($V_H$CD28) comprising the amino acid sequence of SEQ ID NO:42 and a light chain variable region ($V_L$CD28) comprising the amino acid sequence of SEQ ID NO:27, (b) one Fab fragment capable of specific binding to CD79b comprising a heavy chain variable region ($V_H$CD79b) comprising the amino acid sequence of SEQ ID NO:428 and a light chain variable region ($V_L$CD79b) comprising the amino acid sequence of SEQ ID NO:429, and (c) a Fc domain composed of a first and a second subunit capable of stable association comprising one or more amino acid substitution that reduces the binding affinity of the antigen binding molecule to an Fc receptor and/or effector function.

Bispecific Agonistic CD28 Antigen Binding Molecules Monovalent for Binding to CD28 and Bivalent for Binding to a B Cell Surface Antigen (1+2 Format)

In one aspect, the bispecific agonistic CD28 antigen binding molecule is characterized by bivalent binding to the B cell surface antigen.

In another aspect, a bispecific agonistic CD28 antigen binding molecule as disclosed herein is provided, comprising (a) a first Fab fragment capable of specific binding to CD28, (b) a second and a third Fab fragment capable of specific binding to a B cell surface antigen, and (c) a Fc domain composed of a first and a second subunit capable of stable association comprising one or more amino acid substitution that reduces the binding affinity of the antigen binding molecule to an Fc receptor and/or effector function, wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

Fc Domain Modifications Reducing Fc Receptor Binding and/or Effector Function

The Fc domain of the bispecific agonistic CD28 antigen binding molecule of the invention consists of a pair of polypeptide chains comprising heavy chain domains of an immunoglobulin molecule. For example, the Fc domain of an immunoglobulin G (IgG) molecule is a dimer, each subunit of which comprises the CH2 and CH3 IgG heavy chain constant domains. The two subunits of the Fc domain are capable of stable association with each other. The Fc domain confers favorable pharmacokinetic properties to the antigen binding molecules of the invention, including a long serum half-life which contributes to good accumulation in the target tissue and a favorable tissue-blood distribution ratio. On the other side, it may, however, lead to undesirable targeting of the bispecific antibodies of the invention to cells expressing Fc receptors rather than to the preferred antigen-bearing cells.

Accordingly, the Fc domain of the bispecific agonistic CD28 antigen binding molecule of the invention exhibits reduced binding affinity to an Fc receptor and/or reduced effector function, as compared to a native IgG1 Fc domain. In one aspect, the Fc does not substantially bind to an Fc receptor and/or does not induce effector function. In a particular aspect the Fc receptor is an Fcγ receptor. In one aspect, the Fc receptor is a human Fc receptor. In a specific aspect, the Fc receptor is an activating human Fcγ receptor, more specifically human FcγRIIIa, FcγRI or FcγRIIa, most specifically human FcγRIIIa. In one aspect, the Fc domain does not induce effector function. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced dendritic cell maturation, or reduced T cell priming.

In certain aspects, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In one particular aspect, the invention provides an antigen binding molecule, wherein the Fc region comprises one or more amino acid substitution that reduces binding to an Fc receptor, in particular towards Fcγ receptor. In one aspect, the invention provides an antibody, wherein the Fc region comprises one or more amino acid substitution and wherein the ADCC induced by the antibody is reduced to 0-20% of the ADCC induced by an antibody comprising the wild-type human IgG1 Fc region.

In one aspect, the Fc domain of the antigen binding molecule of the invention comprises one or more amino acid mutation that reduces the binding affinity of the Fc domain to an Fc receptor and/or effector function. Typically, the same one or more amino acid mutation is present in each of the two subunits of the Fc domain. In particular, the Fc domain comprises an amino acid substitution at a position of E233, L234, L235, N297, P331 and P329 (EU numbering). In particular, the Fc domain comprises amino acid substitutions at positions 234 and 235 (EU numbering) and/or 329 (EU numbering) of the IgG heavy chains. More particularly, provided is an antigen binding molecule according to the invention which comprises an Fc domain with the amino acid substitutions L234A, L235A and P329G ("P329G LALA", EU numbering) in the IgG heavy chains. The amino acid substitutions L234A and L235A refer to the so-called LALA mutation. The "P329G LALA" combination of amino acid substitutions almost completely abolishes Fcγ receptor binding of a human IgG1 Fc domain and is described in International Patent Appl. Publ. No. WO 2012/130831 A1 which also describes methods of preparing such mutant Fc domains and methods for determining its properties such as Fc receptor binding or effector functions.

Fc domains with reduced Fc receptor binding and/or effector function also include those with substitution of one or more of Fc domain residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

In another aspect, the Fc domain is an IgG4 Fc domain. IgG4 antibodies exhibit reduced binding affinity to Fc receptors and reduced effector functions as compared to IgG1 antibodies. In a more specific aspect, the Fc domain is an IgG4 Fc domain comprising an amino acid substitution at position S228 (Kabat numbering), particularly the amino acid substitution S228P. In a more specific aspect, the Fc domain is an IgG4 Fc domain comprising amino acid substitutions L235E and S228P and P329G (EU numbering). Such IgG4 Fc domain mutants and their Fcγ receptor binding properties are also described in WO 2012/130831.

Mutant Fc domains can be prepared by amino acid deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing.

Binding to Fc receptors can be easily determined e.g. by ELISA, or by Surface Plasmon Resonance (SPR) using standard instrumentation such as a BIAcore instrument (GE Healthcare), and Fc receptors such as may be obtained by recombinant expression. Alternatively, binding affinity of Fc domains or cell activating antibodies comprising an Fc domain for Fc receptors may be evaluated using cell lines known to express particular Fc receptors, such as human NK cells expressing FcγIIIa receptor.

Effector function of an Fc domain, or antigen binding molecules of the invention comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985); U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g. in an animal model such as that disclosed in Clynes et al., Proc Natl Acad Sci USA 95, 652-656 (1998).

In some aspects, binding of the Fc domain to a complement component, specifically to C1q, is reduced. Accordingly, in some aspects wherein the Fc domain is engineered to have reduced effector function, said reduced effector function includes reduced CDC. C1q binding assays may be carried out to determine whether the bispecific antibodies of the invention are able to bind C1q and hence has CDC activity. See e.g., C1q and C3c binding ELISA in WO 2006/029879 and WO 2005/100402. To assess complement activation, a CDC assay may be performed (see, for example, Gazzano-Santoro et al., J Immunol Methods 202, 163 (1996); Cragg et al., Blood 101, 1045-1052 (2003); and Cragg and Glennie, Blood 103, 2738-2743 (2004)).

In one particular aspect, the Fc domain exhibiting reduced binding affinity to an Fc receptor and/or reduced effector function, as compared to a native IgG1 Fc domain, is a human IgG1 Fc domain comprising the amino acid substitutions L234A, L235A and optionally P329G, or a human IgG4 Fc domain comprising the amino acid substitutions S228P, L235E and optionally P329G (numberings according to Kabat EU index). More particularly, it is a human IgG1 Fc domain comprising the amino acid substitutions L234A, L235A and P329G (numbering according to Kabat EU index).

Fc Domain Modifications Promoting Heterodimerization

The bispecific agonistic CD28 antigen binding molecules of the invention comprise different antigen-binding sites, fused to one or the other of the two subunits of the Fc domain, thus the two subunits of the Fc domain may be comprised in two non-identical polypeptide chains. Recombinant co-expression of these polypeptides and subsequent dimerization leads to several possible combinations of the two polypeptides. To improve the yield and purity of the bispecific antigen binding molecules of the invention in recombinant production, it will thus be advantageous to introduce in the Fc domain of the bispecific antigen binding molecules of the invention a modification promoting the association of the desired polypeptides.

Accordingly, in particular aspects the invention relates to the bispecific agonistic CD28 antigen binding molecule with monovalent binding to CD28 comprising (a) one antigen binding domain capable of specific binding to CD28, (b) at least one antigen binding domain capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, wherein the Fc domain comprises a modification promoting the association of the first and second subunit of the Fc domain.

The site of most extensive protein-protein interaction between the two subunits of a human IgG Fc domain is in the CH3 domain of the Fc domain. Thus, in one aspect said modification is in the CH3 domain of the Fc domain.

In a specific aspect said modification is a so-called "knob-into-hole" modification, comprising a "knob" modification in one of the two subunits of the Fc domain and a "hole" modification in the other one of the two subunits of the Fc domain. Thus, the invention relates to the bispecific agonistic CD28 antigen binding molecule with monovalent binding to CD28 comprising (a) one antigen binding domain capable of specific binding to CD28, (b) at least one antigen binding domain capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, wherein the first subunit of the Fc domain comprises knobs and the second subunit of the Fc domain comprises holes according to the knobs into holes method. In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

The knob-into-hole technology is described e.g. in U.S. Pat. Nos. 5,731,168; 7,695,936; Ridgway et al., Prot Eng 9, 617-621 (1996) and Carter. J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in one aspect, in the CH3 domain of the first subunit of the Fc domain of the bispecific antigen binding molecules of the invention an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable. The protuberance and cavity can be made by altering the nucleic acid encoding the polypeptides, e.g. by site-specific mutagenesis, or by peptide synthesis. In a specific aspect, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). In one aspect, in the second subunit of the Fc domain additionally the threonine residue at position 366 is replaced with a serine residue (T366S) and the leucine residue at position 368 is replaced with an alanine residue (L368A).

In yet a further aspect, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). Introduction of these two cysteine residues results in formation of a disulfide bridge between the two subunits of the Fc domain, further stabilizing the dimer (Carter (2001), J Immunol Methods 248, 7-15). In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

In an alternative aspect, a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

The C-terminus of the heavy chain of the bispecific agonistic CD28 antigen binding molecule as reported herein can be a complete C-terminus ending with the amino acid residues PGK. The C-terminus of the heavy chain can be a shortened C-terminus in which one or two of the C terminal amino acid residues have been removed. In one preferred aspect, the C-terminus of the heavy chain is a shortened C-terminus ending P. In one preferred aspect, the C-terminus of the heavy chain is a shortened C-terminus ending PG. In one aspect of all aspects as reported herein, a CD28 antigen binding molecule comprising a heavy chain including a C-terminal CH3 domain as specified herein, comprises the C-terminal glycine-lysine dipeptide (G446 and K447, numbering according to Kabat EU index). In one aspect of all aspects as reported herein, a CD28 antigen binding molecule comprising a heavy chain including a C-terminal CH3 domain, as specified herein, comprises a C-terminal glycine residue (G446, numbering according to Kabat EU index).

Modifications in the Fab Domains

In one aspect, the invention relates to a bispecific agonistic CD28 antigen binding molecule characterized by monovalent binding to CD28 comprising (a) one antigen binding domain capable of specific binding to CD28, (b) at least one antigen binding domain capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, wherein the at least one antigen binding domain capable of specific binding to a tumor-associated antigen is a Fab fragment and in the Fab fragment either the variable domains VH and VL or the constant domains CH1 and CL are exchanged according to the Crossmab technology.

Multispecific antibodies with a domain replacement/exchange in one binding arm (CrossMabVH-VL or CrossMabCH-CL) are described in detail in WO2009/080252 and Schaefer, W. et al, PNAS, 108 (2011) 11187-1191. They clearly reduce the byproducts caused by the mismatch of a light chain against a first antigen with the wrong heavy chain against the second antigen (compared to approaches without such domain exchange).

In one aspect, the invention relates to a bispecific agonistic CD28 antigen binding molecule characterized by monovalent binding to CD28 comprising (a) one antigen binding domain capable of specific binding to CD28, (b) at least one antigen binding domain capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, wherein in the Fab fragments capable of specific binding to a tumor-associated antigen the constant domains CL and CH1 are replaced by each other so that the CHI domain is part of the light chain and the CL domain is part of the heavy chain.

In another aspect, and to further improve correct pairing, the bispecific agonistic CD28 antigen binding molecule characterized by monovalent binding to CD28 comprising (a) one antigen binding domain capable of specific binding to CD28, (b) at least one antigen binding domains capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function, can contain different charged amino acid substitutions (so-called "charged residues"). These modifications are introduced in the crossed or non-crossed CH1 and CL domains. In a particular aspect, the invention relates to a bispecific agonistic CD28 antigen binding molecule, wherein in one of CL domains the amino acid at position 123 (EU numbering) has been replaced by arginine (R) and the amino acid at position 124 (EU numbering) has been substituted by lysine (K) and wherein in one of the CH1 domains the amino acids at position 147 (EU numbering) and at position 213 (EU numbering) have been substituted by glutamic acid (E). In one particular aspect, in the CL domain of the Fab fragment capable of specific binding to CD28 the amino acid at position 123 (EU numbering) has been replaced by arginine (R) and the amino acid at position 124 (EU numbering) has been substituted by lysine (K) and in the CH1 domain of the Fab fragment capable of specific binding to CD28 the amino acids at position 147 (EU numbering) and at position 213 (EU numbering) have been substituted by glutamic acid (E).

Polynucleotides

The invention further provides isolated polynucleotides encoding a bispecific agonistic CD28 antigen binding molecule as described herein or a fragment thereof. The one or more isolated polynucleotides encoding the bispecific agonistic CD28 antigen binding molecule of the invention may be expressed as a single polynucleotide that encodes the entire antigen binding molecule or as multiple (e.g., two or more) polynucleotides that are co-expressed. Polypeptides encoded by polynucleotides that are co-expressed may associate through, e.g., disulfide bonds or other means to form a functional antigen binding molecule. For example, the light chain portion of an immunoglobulin may be encoded by a separate polynucleotide from the heavy chain portion of the immunoglobulin. When co-expressed, the heavy chain polypeptides will associate with the light chain polypeptides to form the immunoglobulin. In some aspects, the isolated polynucleotide encodes the entire bispecific agonistic CD28 antigen binding molecule according to the invention as described herein. In other aspects, the isolated polynucleotide encodes a polypeptide comprised in the bispecific agonistic CD28 antigen binding molecule according to the invention as described herein. In certain aspects the polynucleotide or nucleic acid is DNA. In other aspects, a polynucleotide of the present invention is RNA, for example, in the form of messenger RNA (mRNA). RNA of the present invention may be single stranded or double stranded.

Recombinant Methods

Bispecific agonistic CD28 antigen binding molecules of the invention may be obtained, for example, by solid-state peptide synthesis (e.g. Merrifield solid phase synthesis) or recombinant production. For recombinant production one or more polynucleotide encoding the bispecific agonistic CD28 antigen binding molecule or polypeptide fragments thereof, e.g., as described above, is isolated and inserted into one or more vectors for further cloning and/or expression in a host cell. Such polynucleotide may be readily isolated and sequenced using conventional procedures. In one aspect of the invention, a vector, preferably an expression vector, comprising one or more of the polynucleotides of the invention is provided. Methods which are well known to those skilled in the art can be used to construct expression vectors containing the coding sequence of the antibody (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989); and Ausubel et al., CURRENT PROTOCOLS IN MOLECULAR BIOLOGY, Greene Publishing Associates and Wiley Interscience, N.Y. (1989). The expression vector can be part of a plasmid, virus, or may be a nucleic acid fragment. The expression vector includes an expression cassette into which the polynucleotide encoding the antibody or polypeptide fragments thereof (i.e. the coding region) is cloned in operable association with a promoter and/or other transcription or translation control elements. As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the antibody of the invention or polypeptide fragments thereof, or variants or derivatives thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription.

Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit â-globin, as well as other sequences capable of controlling gene expression in eukaryotic cells. Additional suitable transcription control regions include tissue-specific promoters and enhancers as well as inducible promoters (e.g. promoters inducible tetracyclins). Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the antibody or polypeptide fragments thereof is desired, DNA encoding a signal sequence may be placed upstream of the nucleic acid an antibody of the invention or polypeptide fragments thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase.

DNA encoding a short protein sequence that could be used to facilitate later purification (e.g. a histidine tag) or assist in labeling the bispecific agonistic CD28 antigen binding molecule may be included within or at the ends of the polynucleotide encoding an antibody of the invention or polypeptide fragments thereof.

In a further aspect of the invention, a host cell comprising one or more polynucleotides of the invention is provided. In certain embodiments a host cell comprising one or more vectors of the invention is provided. The polynucleotides and vectors may incorporate any of the features, singly or in combination, described herein in relation to polynucleotides and vectors, respectively. In one aspect, a host cell comprises (e.g. has been transformed or transfected with) a vector comprising a polynucleotide that encodes (part of) an antibody of the invention of the invention. As used herein, the term "host cell" refers to any kind of cellular system which can be engineered to generate the fusion proteins of the invention or fragments thereof. Host cells suitable for replicating and for supporting expression of antigen binding molecules are well known in the art. Such cells may be transfected or transduced as appropriate with the particular expression vector and large quantities of vector containing cells can be grown for seeding large scale fermenters to obtain sufficient quantities of the antigen binding molecule for clinical applications. Suitable host cells include prokaryotic microorganisms, such as *E. coli*, or various eukaryotic cells, such as Chinese hamster ovary cells (CHO), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross, Nat Biotech 22, 1409-1414 (2004), and Li et al., Nat Biotech 24, 210-215 (2006).

Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells. Plant cell cultures can also be utilized as hosts. See e.g. U.S. Pat. Nos. 5,959,177, 6,040, 498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather, Biol Reprod 23, 243-251 (1980)), monkey kidney cells (CV1), African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)), MRC 5 cells, and FS4 cells. Other useful mammalian host cell lines include Chinese hamster ovary (CHO) cells, including dhfr-CHO cells (Urlaub et al., Proc Natl Acad Sci USA 77, 4216 (1980)); and myeloma cell lines such as YO, NS0, P3X63 and Sp2/0. For a review of certain mammalian host cell lines suitable for protein production, see, e.g., Yazaki and Wu, Methods in Molecular Biology, Vol. 248 (B. K. C. Lo, ed., Humana Press, Totowa, N.J.), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., Y0, NS0, Sp20 cell). Standard technologies are known in the art to express foreign genes in these systems. Cells expressing a polypeptide comprising either the heavy or the light chain of an immunoglobulin, may be engineered so as to also express the other of the immunoglobulin chains such that the expressed product is an immunoglobulin that has both a heavy and a light chain.

In one aspect, a method of producing a bispecific agonistic CD28 antigen binding molecule of the invention or polypeptide fragments thereof is provided, wherein the method comprises culturing a host cell comprising polynucleotides encoding the antibody of the invention or polypeptide fragments thereof, as provided herein, under conditions suitable for expression of the antibody of the invention or polypeptide fragments thereof, and recovering the antibody of the invention or polypeptide fragments thereof from the host cell (or host cell culture medium).

In certain aspects the moieties capable of specific binding to a target cell antigen (e.g. Fab fragments) forming part of the antigen binding molecule comprise at least an immunoglobulin variable region capable of binding to an antigen. Variable regions can form part of and be derived from naturally or non-naturally occurring antibodies and fragments thereof. Methods to produce polyclonal antibodies and monoclonal antibodies are well known in the art (see e.g. Harlow and Lane, "Antibodies, a laboratory manual", Cold Spring Harbor Laboratory, 1988). Non-naturally occurring antibodies can be constructed using solid phase-peptide synthesis, can be produced recombinantly (e.g. as described in U.S. Pat. No. 4,186,567) or can be obtained, for example, by screening combinatorial libraries comprising variable heavy chains and variable light chains (see e.g. U.S. Pat. No. 5,969,108 to McCafferty).

Any animal species of immunoglobulin can be used in the invention. Non-limiting immunoglobulins useful in the present invention can be of murine, primate, or human origin. If the fusion protein is intended for human use, a chimeric form of immunoglobulin may be used wherein the constant regions of the immunoglobulin are from a human. A humanized or fully human form of the immunoglobulin can also be prepared in accordance with methods well known in the art (see e. g. U.S. Pat. No. 5,565,332 to Winter). Humanization may be achieved by various methods including, but not limited to (a) grafting the non-human (e.g., donor antibody) CDRs onto human (e.g. recipient antibody) framework and constant regions with or without retention of critical framework residues (e.g. those that are important for retaining good antigen binding affinity or antibody functions), (b) grafting only the non-human specificity-determining regions (SDRs or a-CDRs; the residues critical for the antibody-antigen interaction) onto human framework and constant regions, or (c) transplanting the entire non-human variable domains, but "cloaking" them with a human-like section by replacement of surface residues. Humanized antibodies and methods of making them are reviewed, e.g., in Almagro and Fransson, Front Biosci 13, 1619-1633 (2008), and are further described, e.g., in Riechmann et al., Nature 332, 323-329 (1988); Queen et al., Proc Natl Acad Sci USA 86, 10029-10033 (1989); U.S. Pat. Nos. 5,821,337, 7,527,791, 6,982,321, and 7,087,409; Jones et al., Nature 321, 522-525 (1986); Morrison et al., Proc Natl Acad Sci 81, 6851-6855 (1984); Morrison and Oi, Adv Immunol 44, 65-92 (1988); Verhoeyen et al., Science 239, 1534-1536 (1988); Padlan, Molec Immun 31(3), 169-217 (1994); Kashmiri et al., Methods 36, 25-34 (2005) (describing SDR (a-CDR) grafting); Padlan, Mol Immunol 28, 489-498 (1991) (describing "resurfacing"); Dall'Acqua et al., Methods 36, 43-60 (2005) (describing "FR shuffling"); and Osbourn et al., Methods 36, 61-68 (2005) and Klimka et al., Br J Cancer 83, 252-260 (2000) (describing the "guided selection" approach to FR shuffling). Particular immunoglobulins according to the invention are human immunoglobulins. Human antibodies and human variable regions can be produced using various techniques known in the art. Human antibodies are described generally in van Dijk and van de Winkel, Curr Opin Pharmacol 5, 368-74 (2001) and Lonberg, Curr Opin Immunol 20, 450-459 (2008). Human variable regions can form part of and be derived from human monoclonal antibodies made by the hybridoma method (see e.g. Monoclonal Antibody Production Techniques and Applications, pp. 51-63 (Marcel Dekker, Inc., New York, 1987)). Human antibodies and human variable regions may also be prepared by administering an immunogen to a transgenic animal that has been modified to produce intact human antibodies or intact antibodies with human variable regions in response to antigenic challenge (see e.g. Lonberg, Nat Biotech 23, 1117-1125 (2005). Human antibodies and human variable regions may also be generated by isolating Fv clone variable region sequences selected from human-derived phage display libraries (see e.g., Hoogenboom et al. in Methods in Molecular Biology 178, 1-37 (O'Brien et al., ed., Human Press, Totowa, N.J., 2001); and McCafferty et al., Nature 348, 552-554; Clackson et al., Nature 352, 624-628 (1991)). Phage typically display antibody fragments, either as single-chain Fv (scFv) fragments or as Fab fragments.

In certain aspects, the bispecific agonistic CD28 antigen binding molecules are engineered to have enhanced binding affinity according to, for example, the methods disclosed in PCT publication WO 2012/020006 (see Examples relating to affinity maturation) or U.S. Pat. Appl. Publ. No. 2004/0132066. The ability of the antigen binding molecules of the invention to bind to a specific antigenic determinant can be measured either through an enzyme-linked immunosorbent assay (ELISA) or other techniques familiar to one of skill in the art, e.g. surface plasmon resonance technique (Liljeblad, et al., Glyco J 17, 323-329 (2000)), and traditional binding assays (Heeley, Endocr Res 28, 217-229 (2002)). Competition assays may be used to identify an antigen binding molecule that competes with a reference antibody for binding to a particular antigen. In certain embodiments, such a competing antigen binding molecule binds to the same epitope (e.g. a linear or a conformational epitope) that is bound by the reference antigen binding molecule. Detailed exemplary methods for mapping an epitope to which an antigen binding molecule binds are provided in Morris (1996) "Epitope Mapping Protocols", in Methods in Molecular Biology vol. 66 (Humana Press, Totowa, N.J.). In an exemplary competition assay, immobilized antigen is incubated in a solution comprising a first labeled antigen binding molecule that binds to the antigen and a second unlabeled antigen binding molecule that is being tested for its ability to compete with the first antigen binding molecule for binding to the antigen. The second antigen binding molecule may be present in a hybridoma supernatant. As a control, immobilized antigen is incubated in a solution comprising the first labeled antigen binding molecule but not the second unlabeled antigen binding molecule. After incubation under conditions permissive for binding of the first antibody to the antigen, excess unbound antibody is removed, and the amount of label associated with immobilized antigen is measured. If the amount of label associated with immobilized antigen is substantially reduced in the test sample relative to the control sample, then that indicates that the second antigen binding molecule is competing with the first antigen binding molecule for binding to the antigen. See Harlow and Lane (1988) Antibodies: A Laboratory Manual ch. 14 (Cold Spring Harbor Laboratory, Cold Spring Harbor, N.Y.).

Bispecific agonistic CD28 antigen binding molecules of the invention prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the antigen binding molecule binds. For example, for affinity chromatography purification of antigen binding molecules of the invention, a matrix with protein A or protein G may be used. Sequential Protein A or G affinity chromatography and size exclusion chromatography can be used to isolate an antigen binding molecule essentially as described in the Examples. The purity of the CD28 antigen binding molecule or fragments thereof can be determined by any of a variety of well-known analytical methods including gel electrophoresis, high pressure liquid chromatography, and the like. For example, the CD28 antigen binding molecule expressed as described in the Examples were shown to be intact and properly assembled as demonstrated by reducing and non-reducing SDS-PAGE.

Assays

The bispecific agonistic CD28 antigen binding molecules provided herein may be identified, screened for, or characterized for their physical/chemical properties and/or biological activities by various assays known in the art.

1. Affinity Assays

The affinity of the antigen binding molecule provided herein for the corresponding target can be determined in accordance with the methods set forth in the Examples by surface plasmon resonance (SPR), using standard instrumentation such as a Proteon instrument (Bio-rad), and receptors or target proteins such as may be obtained by recombinant expression. The affinity of the TNF family ligand trimer-containing antigen binding molecule for the target cell antigen can also be determined by surface plasmon resonance (SPR), using standard instrumentation such as a Proteon instrument (Bio-rad), and receptors or target proteins such as may be obtained by recombinant expression. A specific illustrative and exemplary embodiment for measuring binding affinity is described in Example 4. According to one aspect, $K_D$ is measured by surface plasmon resonance using a Proteon® machine (Bio-Rad) at 25° C.

2. Binding Assays and Other Assays

Binding of the bispecific antigen binding molecule provided herein to the corresponding receptor expressing cells may be evaluated using cell lines expressing the particular receptor or target antigen, for example by flow cytometry (FACS). In one aspect, CHO cells expressing human CD28 (parental cell line CHO-k1 ATCC #CCL-6I, modified to stably overexpress human CD28) are used in the binding assay.

In a further aspect, cancer cell lines expressing the target cell antigen, for example FAP or CEA, CD19 or CD79b, were used to demonstrate the binding of the bispecific antigen binding molecules to the target cell antigen.

3. Activity Assays

In one aspect, assays are provided for identifying CD28 antigen binding molecules having biological activity. Biological activity may include, e.g. T cell proliferation and cytokine secretion as measured with the method as described in Example 6 or tumor cell killing as measured in Example 7. Antibodies having such biological activity in vivo and/or in vitro are also provided.

Pharmaceutical Compositions, Formulations and Routes of Administration

In a further aspect, the invention provides pharmaceutical compositions comprising any of the bispecific agonistic CD28 antigen binding molecules provided herein, e.g., for use in any of the below therapeutic methods. In one embodiment, a pharmaceutical composition comprises a bispecific agonistic CD28 antigen binding molecule provided herein and at least one pharmaceutically acceptable excipient. In another aspect, a pharmaceutical composition comprises a bispecific agonistic CD28 antigen binding molecule provided herein and at least one additional therapeutic agent, e.g., as described below.

Pharmaceutical compositions of the present invention comprise a therapeutically effective amount of one or more bispecific antigen binding molecules dissolved or dispersed in a pharmaceutically acceptable excipient. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one bispecific agonistic CD28 antigen binding molecule and optionally an additional active ingredient will be known to those of skill in the art in light of the present disclosure, as exemplified by Remington's Pharmaceutical Sciences, 18th Ed. Mack Printing Company, 1990, incorporated herein by reference. In particular, the compositions are lyophilized formulations or aqueous solutions. As used herein, "pharmaceutically acceptable excipient" includes any and all solvents, buffers, dispersion media, coatings, surfactants, antioxidants, preservatives (e.g. antibacterial agents, antifungal agents), isotonic agents, salts, stabilizers and combinations thereof, as would be known to one of ordinary skill in the art.

Parenteral compositions include those designed for administration by injection, e.g. subcutaneous, intradermal, intralesional, intravenous, intraarterial intramuscular, intrathecal or intraperitoneal injection. For injection, the TNF family ligand trimer-containing antigen binding molecules of the invention may be formulated in aqueous solutions, preferably in physiologically compatible buffers such as Hanks' solution, Ringer's solution, or physiological saline buffer. The solution may contain formulatory agents such as suspending, stabilizing and/or dispersing agents. Alternatively, the bispecific agonistic CD28 antigen binding molecule may be in powder form for constitution with a suitable vehicle, e.g., sterile pyrogen-free water, before use. Sterile injectable solutions are prepared by incorporating the fusion proteins of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less that 0.5 ng/mg protein. Suitable pharmaceutically acceptable excipients include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company, 1990). Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof. Exemplary pharmaceutically acceptable excipients herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuP1120, are described in US Patent Publication Nos. 2005/0260186 and 2006/0104968. In one aspect, a sHASEGP is combined with one or more additional glycosaminoglycanases such as chondroitinases. Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer. In addition to the compositions described previously, the bispecific agonistic CD28 antigen binding molecule may also be formulated as a depot preparation. Such long acting formulations may be administered by implantation (for example subcutaneously or intramuscularly) or by intramuscular injection. Thus, for example, the bispecific agonistic CD28 antigen binding molecule may be formulated with suitable polymeric or hydrophobic materials (for example as an emulsion in an acceptable oil) or ion exchange resins, or as sparingly soluble derivatives, for example, as a sparingly soluble salt.

Pharmaceutical compositions comprising the bispecific agonistic CD28 antigen binding molecule of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen. The bispecific agonistic CD28 antigen binding molecule of the invention may be formulated into a composition in a free acid or base, neutral or salt form. Pharmaceutically acceptable salts are salts that substantially retain the biological activity of the free acid or base. These include the acid addition salts, e.g. those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other protic solvents than are the corresponding free base forms. The composition herein may also contain more than one active ingredients as necessary for the particular indication being treated, preferably those with complementary activities that do not adversely affect each other. Such active ingredients are suitably present in combination in amounts that are effective for the purpose intended. The formulations to be used for in vivo administration are generally sterile. Sterility may be readily accomplished, e.g., by filtration through sterile filtration membranes.

Therapeutic Methods and Compositions

Any of the bispecific agonistic CD28 antigen binding molecules provided herein may be used in therapeutic methods, either alone or in combination.

In one aspect, a bispecific agonistic CD28 antigen binding molecule for use as a medicament is provided. In further aspects, a bispecific agonistic CD28 antigen binding molecule for use in treating cancer is provided. In certain aspects, a bispecific agonistic CD28 antigen binding molecule for use in a method of treatment is provided. In certain aspects, herein is provided a bispecific agonistic CD28 antigen binding molecule for use in a method of treating an individual having cancer comprising administering to the individual an effective amount of the bispecific agonistic CD28 antigen binding molecule. In one such embodiment, the method further comprises administering to the individual an effective amount of at least one additional therapeutic agent.

In one aspect, the bispecific agonistic CD28 antigen binding molecule for use in treating a B-cell proliferative disorder. In particular aspects, the bispecific agonistic CD28 antigen binding molecule is for use in treating a B-cell proliferative disorder selected from the group consisting of Non-Hodgkin lymphoma (NHL), acute lymphocytic leukemia (ALL), chronic lymphocytic leukemia (CLL), diffuse large B-cell lymphoma (DLBCL), follicular lymphoma (FL), mantle-cell lymphoma (MCL), marginal zone lymphoma (MZL), Multiple myeloma (MM) and Hodgkin lymphoma (HL). In one particular aspect, the B-cell cancer is non-Hodgkin lymphoma or acute lymphoblastic leukemia. In certain aspects, a bispecific agonistic CD28 antigen binding molecule for use in a method of treatment is provided. In certain aspects, herein is provided a bispecific agonistic CD28 antigen binding molecule for use in a method of treating an individual having cancer comprising administering to the individual an effective amount of the bispecific agonistic CD28 antigen binding molecule. In another aspect, provided is a bispecific agonistic CD28 antigen binding molecule for use in a method of treating an individual having B-cell proliferative disorder, in particular a B-cell proliferative disorder selected from the group consisting of Non-Hodgkin lymphoma (NHL), acute lymphocytic leukemia (ALL), chronic lymphocytic leukemia (CLL), diffuse large B-cell lymphoma (DLBCL), follicular lymphoma (FL), mantle-cell lymphoma (MCL), marginal zone lymphoma (MZL), Multiple myeloma (MM) and Hodgkin lymphoma (HL), comprising administering to the individual an effective amount of the bispecific agonistic CD28 antigen binding molecule. In one such embodiment, the method further comprises administering to the individual an effective amount of at least one additional therapeutic agent.

In further aspects, a bispecific agonistic CD28 antigen binding molecule as described herein for use in cancer immunotherapy is provided. In certain embodiments, a bispecific agonistic CD28 antigen binding molecule for use in a method of cancer immunotherapy is provided. An "individual" according to any of the above aspects is preferably a human.

In a further aspect, herein is provided for the use of a bispecific agonistic CD28 antigen binding molecule as described herein in the manufacture or preparation of a medicament. In one embodiment, the medicament is for treatment of cancer. In a further aspect, the medicament is for use in a method of treating cancer comprising administering to an individual having cancer an effective amount of the medicament. In one such aspect, the method further comprises administering to the individual an effective amount of at least one additional therapeutic agent, e.g., as described below. In another aspect, the medicament is for treatment of a B-cell proliferative disorder. In a further aspect, the medicament is for use in a method of treating cancer or a B-cell proliferative disorder comprising administering to an individual having cancer an effective amount of the medicament.

In a further aspect, herein is provided a method for treating a cancer. In one aspect, the method comprises administering to an individual having cancer an effective amount of a bispecific agonistic CD28 antigen binding molecule. In one such aspect, the method further comprises administering to the individual an effective amount of at least one additional therapeutic agent, as described below. An "individual" according to any of the above aspects may be a human.

In a further aspect, herein are provided pharmaceutical formulations comprising any of the bispecific agonistic CD28 antigen binding molecules as reported herein, e.g., for use in any of the above therapeutic methods. In one aspect, a pharmaceutical formulation comprises any of the bispecific agonistic CD28 antigen binding molecules as reported herein and a pharmaceutically acceptable carrier. In another aspect, a pharmaceutical formulation comprises any of the bispecific agonistic CD28 antigen binding molecules as reported herein and at least one additional therapeutic agent.

Bispecific agonistic CD28 antigen binding molecules as reported herein can be used either alone or in combination with other agents in a therapy. For instance, a bispecific agonistic CD28 antigen binding molecule as reported herein may be co-administered with at least one additional therapeutic agent.

Such combination therapies noted above encompass combined administration (where two or more therapeutic agents are included in the same or separate formulations), and separate administration, in which case, administration of the antibody as reported herein can occur prior to, simultaneously, and/or following, administration of the additional therapeutic agent or agents. In one aspect, administration of the bispecific agonistic CD28 antigen binding molecule and administration of an additional therapeutic agent occur within about one month, or within about one, two or three weeks, or within about one, two, three, four, five, or six days, of each other.

An antigen binding molecule as reported herein (and any additional therapeutic agent) can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. Dosing can be by any suitable route, e.g. by injections, such as intravenous or subcutaneous injections, depending in part on whether the administration is brief or chronic. Various dosing schedules including but not limited to single or multiple administrations over various timepoints, bolus administration, and pulse infusion are contemplated herein.

Bispecific agonistic CD28 antigen binding molecules as described herein would be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The bispecific agonistic CD28 antigen binding molecule need not be, but is optionally formulated with one or more agents currently used to prevent or treat the disorder in question. The effective amount of such other agents depends on the amount of antibody present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

For the prevention or treatment of disease, the appropriate dosage of a bispecific agonistic CD28 antigen binding molecule as described herein (when used alone or in combination with one or more other additional therapeutic agents) will depend on the type of disease to be treated, the type of antibody, the severity and course of the disease, whether the antibody is administered for preventive or therapeutic purposes, previous therapy, the patient's clinical history and response to the antibody, and the discretion of the attending physician. The bispecific agonistic CD28 antigen binding molecule is suitably administered to the patient at one time or over a series of treatments. Depending on the type and severity of the disease, about 1 µg/kg to 15 mg/kg (e.g. 0.5 mg/kg-10 mg/kg) of bispecific agonistic CD28 antigen binding molecule can be an initial candidate dosage for administration to the patient, whether, for example, by one or more separate administrations, or by continuous infusion. One typical daily dosage might range from about 1 µs/kg to 100 mg/kg or more, depending on the factors mentioned above. For repeated administrations over several days or longer, depending on the condition, the treatment would generally be sustained until a desired suppression of disease symptoms occurs. One exemplary dosage of the antibody would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. Such doses may be administered intermittently, e.g. every week or every three weeks (e.g. such that the patient receives from about two to about twenty, or e.g. about six doses of the antibody). An initial higher loading dose, followed by one or more lower doses may be administered. However, other dosage regimens may be useful. The progress of this therapy is easily monitored by conventional techniques and assays.

Other Agents and Treatments

The bispecific agonistic CD28 antigen binding molecules of the invention may be administered in combination with one or more other agents in therapy. For instance, an antigen binding molecule of the invention may be co-administered with at least one additional therapeutic agent. The term "therapeutic agent" encompasses any agent that can be administered for treating a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is another anti-cancer agent, for example a microtubule disruptor, an antimetabolite, a topoisomerase inhibitor, a DNA intercalator, an alkylating agent, a hormonal therapy, a kinase inhibitor, a receptor antagonist, an activator of tumor cell apoptosis, or an antiangiogenic agent. In certain aspects, an additional therapeutic agent is an immunomodulatory agent, a cytostatic agent, an inhibitor of cell adhesion, a cytotoxic or cytostatic agent, an activator of cell apoptosis, or an agent that increases the sensitivity of cells to apoptotic inducers.

Thus, provided are bispecific agonistic CD28 antigen binding molecules of the invention or pharmaceutical compositions comprising them for use in the treatment of cancer, wherein the bispecific antigen binding molecule is administered in combination with a chemotherapeutic agent, radiation and/or other agents for use in cancer immunotherapy.

Such other agents are suitably present in combination in amounts that are effective for the purpose intended. The effective amount of such other agents depends on the amount of fusion protein used, the type of disorder or treatment, and other factors discussed above. The bispecific antigen binding molecule or antibody of the invention are generally used in the same dosages and with administration routes as described herein, or about from 1 to 99% of the dosages described herein, or in any dosage and by any route that is empirically/clinically determined to be appropriate. Such combination therapies noted above encompass combined administration (where two or more therapeutic agents are included in the same or separate compositions), and separate administration, in which case, administration of the bispecific antigen binding molecule or antibody of the invention can occur prior to, simultaneously, and/or following, administration of the additional therapeutic agent and/or adjuvant.

In a further aspect, provided is the bispecific agonistic CD28 antigen binding molecule as described herein before for use in the treatment of cancer, wherein the bispecific antigen binding molecule is administered in combination with another immunomodulator. The term "immunomodulator" refers to any substance including a monoclonal antibody that effects the immune system. The molecules of the inventions can be considered immunomodulators. Immunomodulators can be used as anti-neoplastic agents for the treatment of cancer. In one aspect, immunomodulators include, but are not limited to anti-CTLA4 antibodies (e.g. ipilimumab), anti-PD1 antibodies (e.g. nivolumab or pembrolizumab), PD-L1 antibodies (e.g. atezolizumab, avelumab or durvalumab), OX-40 antibodies, 4-1BB antibodies and GITR antibodies. Such combination therapies noted above encompass combined administration (where two or more therapeutic agents are included in the same or separate compositions), and separate administration, in which case, administration of the bispecific antigen binding molecule can occur prior to, simultaneously, and/or following, administration of the additional therapeutic agent and/or adjuvant.

Combination with T Cell Bispecific Antibodies

In one aspect, the bispecific agonistic CD28 antigen binding molecules of the invention may be administered in combination with T-cell activating anti-CD3 bispecific antibodies. In one aspect, the T-cell activating anti-CD3 bispecific antibody specific for a tumor-associated antigen is an anti-CEA/anti-CD3 bispecific antibody or an anti-MCSP/anti-CD3 bispecific antibody. In one particular aspect, the T-cell activating anti-CD3 bispecific antibody specific for a tumor-associated antigen is an anti-CEA/anti-CD3 bispecific antibody.

In one aspect, a bispecific agonistic CD28 antigen binding molecule comprising at least one antigen binding domain capable of specific binding to a tumor-associated antigen (TAA) selected from the group consisting of Fibroblast Activation Protein (FAP), Carcinoembryonic Antigen (CEA), Folate receptor alpha (FolR1), Melanoma-associated Chondroitin Sulfate Proteoglycan (MCSP), Epidermal Growth Factor Receptor (EGFR), human epidermal growth factor receptor 2 (HER2) and p95HER2 is suitable for administration in combination with an anti-CEA/anti-CD3 bispecific antibody. In another particular aspect, TAA is selected from the group consisting of Fibroblast Activation Protein (FAP), Carcinoembryonic Antigen (CEA), EpCAM, HER3, CD30 or TPBG (5T4).

In a particular aspect, the anti-CD3 bispecific antibody for use in the combination comprises a first antigen binding domain comprising a heavy chain variable region ($V_H$CD3) comprising CDR-H1 sequence of SEQ ID NO:439, CDR-H2 sequence of SEQ ID NO:440, and CDR-H3 sequence of SEQ ID NO:441; and/or a light chain variable region ($V_L$CD3) comprising CDR-L1 sequence of SEQ ID NO:442, CDR-L2 sequence of SEQ ID NO:443, and CDR-L3 sequence of SEQ ID NO:444. More particularly, the anti-CD3 bispecific comprises a first antigen binding domain comprising a heavy chain variable region ($V_H$CD3) that is at least 90%, 95%, 96%, 97%, 98%, or 99% identical to the amino acid sequence of SEQ ID NO:445 and/or a light chain variable region ($V_L$CD3) that is at least 90%, 95%, 96%, 97%, 98%, or 99% identical to the amino acid sequence of SEQ ID NO:446. In a further aspect, the anti-CD3 bispecific antibody comprises a heavy chain variable region ($V_H$CD3) comprising the amino acid sequence of SEQ ID NO:445 and/or a light chain variable region ($V_L$CD3) comprising the amino acid sequence of SEQ ID NO:446.

In another aspect, the anti-CD3 bispecific antibody for use in the combination comprises a first antigen binding domain comprising a heavy chain variable region ($V_H$CD3) comprising CDR-H1 sequence of SEQ ID NO:596, CDR-H2 sequence of SEQ ID NO:597, and CDR-H3 sequence of SEQ ID NO:598; and/or a light chain variable region ($V_L$CD3) comprising CDR-L1 sequence of SEQ ID NO:599, CDR-L2 sequence of SEQ ID NO:600, and CDR-L3 sequence of SEQ ID NO:601. More particularly, the anti-CD3 bispecific comprises a first antigen binding domain comprising a heavy chain variable region ($V_H$CD3) that is at least 90%, 95%, 96%, 97%, 98%, or 99% identical to the amino acid sequence of SEQ ID NO:602 and/or a light chain variable region ($V_L$CD3) that is at least 90%, 95%, 96%, 97%, 98%, or 99% identical to the amino acid sequence of SEQ ID NO:603. In a further aspect, the anti-CD20/anti-CD3 bispecific antibody comprises a heavy chain variable region ($V_H$CD3) comprising the amino acid sequence of SEQ ID NO:602 and/or a light chain variable region ($V_L$CD3) comprising the amino acid sequence of SEQ ID NO:603.

In another aspect, the anti-CD3 bispecific antibody for use in the combination comprises a first antigen binding domain comprising a heavy chain variable region ($V_H$CD3) comprising CDR-H1 sequence of SEQ ID NO:604, CDR-H2 sequence of SEQ ID NO:605, and CDR-H3 sequence of SEQ ID NO:606; and/or a light chain variable region ($V_L$CD3) comprising CDR-L1 sequence of SEQ ID NO:607, CDR-L2 sequence of SEQ ID NO:608, and CDR-L3 sequence of SEQ ID NO:609. More particularly, the anti-CD3 bispecific comprises a first antigen binding domain comprising a heavy chain variable region ($V_H$CD3) that is at least 90%, 95%, 96%, 97%, 98%, or 99% identical to the amino acid sequence of SEQ ID NO:610 and/or a light chain variable region ($V_L$CD3) that is at least 90%, 95%, 96%, 97%, 98%, or 99% identical to the amino acid sequence of SEQ ID NO:611. In a further aspect, the anti-CD20/anti-CD3 bispecific antibody comprises a heavy chain variable region ($V_H$CD3) comprising the amino acid sequence of SEQ ID NO:610 and/or a light chain variable region ($V_L$CD3) comprising the amino acid sequence of SEQ ID NO:611.

In one particular aspect, the anti-CEA/anti-CD3 bispecific antibody comprises a polypeptide that is at least 95%, 96%, 97%, 98%, or 99% identical to the sequence of SEQ ID NO: 161, a polypeptide that is at least 95%, 96%, 97%, 98%, or 99% identical to the sequence of SEQ ID NO: 162, a polypeptide that is at least 95%, 96%, 97%, 98%, or 99% identical to the sequence of SEQ ID NO: 163, and a polypeptide that is at least 95%, 96%, 97%, 98%, or 99% identical to the sequence of SEQ ID NO: 164. In a further particular embodiment, the bispecific antibody comprises a polypeptide sequence of SEQ ID NO: 161, a polypeptide sequence of SEQ ID NO: 162, a polypeptide sequence of SEQ ID NO: 163 and a polypeptide sequence of SEQ ID NO: 164 (CEA CD3 TCB).

In another particular aspect, the anti-CEA/anti-CD3 bispecific antibody comprises a polypeptide that is at least 95%, 96%, 97%, 98%, or 99% identical to the sequence of SEQ ID NO:165, a polypeptide that is at least 95%, 96%, 97%, 98%, or 99% identical to the sequence of SEQ ID NO:166, a polypeptide that is at least 95%, 96%, 97%, 98%, or 99% identical to the sequence of SEQ ID NO:167, and a polypeptide that is at least 95%, 96%, 97%, 98%, or 99% identical to the sequence of SEQ ID NO:168. In a further particular embodiment, the bispecific antibody comprises a polypeptide sequence of SEQ ID NO:165, a polypeptide sequence of SEQ ID NO:166, a polypeptide sequence of SEQ ID NO:167 and a polypeptide sequence of SEQ ID NO:168 (CEACAM5 CD3 TCB).

Particular bispecific antibodies are further described in PCT publication no. WO 2014/131712 A1. In a further aspect, the anti-CEA/anti-CD3 bispecific antibody may also comprise a bispecific T cell engager (BiTE®). In a further aspect, the anti-CEA/anti-CD3 bispecific antibody is a bispecific antibody as described in WO 2007/071426 or WO 2014/131712.

In another aspect, a bispecific agonistic CD28 antigen binding molecule of the invention comprising an antigen binding domain capable of specific binding to a B cell surface antigen may be administered in combination with T-cell activating anti-CD3 bispecific antibodies. In one aspect, the T-cell activating anti-CD3 bispecific antibody is specific for a B cell surface antigen, in particular it is an anti-CD20/anti-CD3 bispecific antibody.

The anti-CD20/anti-CD3 bispecific antibodies as used herein are bispecific antibodies comprising a first antigen binding domain that binds to CD3, and a second antigen binding domain that binds to CD20. Thus, the anti-CD20/anti-CD3 bispecific antibody as used herein comprises a first antigen binding domain comprising a heavy chain variable region ($V_H$CD3) and a light chain variable region ($V_L$CD3), and a second antigen binding domain comprising a heavy chain variable region ($V_H$CD20) and a light chain variable region ($V_L$CD20).

In a particular aspect, the anti-CD20/anti-CD3 bispecific antibody for use in the combination comprises a first antigen binding domain comprising a heavy chain variable region ($V_H$CD3) comprising CDR-H1 sequence of SEQ ID NO:439, CDR-H2 sequence of SEQ ID NO:440, and CDR-H3 sequence of SEQ ID NO:441; and/or a light chain variable region ($V_L$CD3) comprising CDR-L1 sequence of SEQ ID NO:442, CDR-L2 sequence of SEQ ID NO:443, and CDR-L3 sequence of SEQ ID NO:444. More particularly, the anti-CD20/anti-CD3 bispecific comprises a first antigen binding domain comprising a heavy chain variable region ($V_H$CD3) that is at least 90%, 95%, 96%, 97%, 98%, or 99% identical to the amino acid sequence of SEQ ID NO:445 and/or a light chain variable region ($V_L$CD3) that is at least 90%, 95%, 96%, 97%, 98%, or 99% identical to the amino acid sequence of SEQ ID NO:446. In a further aspect, the anti-CD20/anti-CD3 bispecific antibody comprises a heavy chain variable region ($V_H$CD3) comprising the amino acid sequence of SEQ ID NO:445 and/or a light chain variable region (V$_L$CD3) comprising the amino acid sequence of SEQ ID NO:446.

In one aspect, the antibody that specifically binds to CD3 is a full-length antibody. In one aspect, the antibody that specifically binds to CD3 is an antibody of the human IgG class, particularly an antibody of the human IgG$_1$ class. In one aspect, the antibody that specifically binds to CD3 is an antibody fragment, particularly a Fab molecule or a scFv molecule, more particularly a Fab molecule. In a particular aspect, the antibody that specifically binds to CD3 is a crossover Fab molecule wherein the variable domains or the constant domains of the Fab heavy and light chain are exchanged (i.e. replaced by each other). In one aspect, the antibody that specifically binds to CD3 is a humanized antibody.

In another aspect, the anti-CD20/anti-CD3 bispecific antibody comprises a second antigen binding domain comprising a heavy chain variable region (V$_H$CD20) comprising CDR-H1 sequence of SEQ ID NO:447, CDR-H2 sequence of SEQ ID NO:448, and CDR-H3 sequence of SEQ ID NO:449, and/or a light chain variable region (V$_L$CD20) comprising CDR-L1 sequence of SEQ ID NO:450, CDR-L2 sequence of SEQ ID NO:451, and CDR-L3 sequence of SEQ ID NO:452. More particularly, the anti-CD20/anti-CD3 bispecific comprises a second antigen binding domain comprising a heavy chain variable region (V$_H$CD20) that is at least 90%, 95%, 96%, 97%, 98%, or 99% identical to the amino acid sequence of SEQ ID NO:453 and/or a light chain variable region (V$_L$CD20) that is at least 90%, 95%, 96%, 97%, 98%, or 99% identical to the amino acid sequence of SEQ ID NO:454. In a further aspect, the anti-CD20/anti-CD3 bispecific comprises a second antigen binding domain comprising a heavy chain variable region (V$_H$CD20) comprising the amino acid sequence of SEQ ID NO:453 and/or a light chain variable region (V$_L$CD20) comprising the amino acid sequence of SEQ ID NO:454.

In another particular aspect, the anti-CD20/anti-CD3 bispecific antibody comprises a third antigen binding domain that binds to CD20. In particular, the anti-CD20/anti-CD3 bispecific antibody comprises a third antigen binding domain comprising a heavy chain variable region (V$_H$CD20) comprising CDR-H1 sequence of SEQ ID NO:447, CDR-H2 sequence of SEQ ID NO:448, and CDR-H3 sequence of SEQ ID NO:449; and/or a light chain variable region (V$_L$CD20) comprising CDR-L1 sequence of SEQ ID NO:450, CDR-L2 sequence of SEQ ID NO:451, and CDR-L3 sequence of SEQ ID NO:452. More particularly, the anti-CD20/anti-CD3 bispecific comprises a third antigen binding domain comprising a heavy chain variable region (V$_H$CD20) that is at least 90%, 95%, 96%, 97%, 98%, or 99% identical to the amino acid sequence of SEQ ID NO:453 and/or a light chain variable region (V$_L$CD20) that is at least 90%, 95%, 96%, 97%, 98%, or 99% identical to the amino acid sequence of SEQ ID NO:454. In a further aspect, the anti-CD20/anti-CD3 bispecific comprises a third antigen binding domain comprising a heavy chain variable region (V$_H$CD20) comprising the amino acid sequence of SEQ ID NO:453 and/or a light chain variable region (V$_L$CD20) comprising the amino acid sequence of SEQ ID NO:454.

In a further aspect, the anti-CD20/anti-CD3 bispecific antibody is bispecific antibody, wherein the first antigen binding domain is a cross-Fab molecule wherein the variable domains or the constant domains of the Fab heavy and light chain are exchanged, and the second and third, if present, antigen binding domain is a conventional Fab molecule.

In another aspect, the anti-CD20/anti-CD3 bispecific antibody is bispecific antibody, wherein (i) the second antigen binding domain is fused at the C-terminus of the Fab heavy chain to the N-terminus of the Fab heavy chain of the first antigen binding domain, the first antigen binding domain is fused at the C-terminus of the Fab heavy chain to the N-terminus of the first subunit of the Fc domain, and the third antigen binding domain is fused at the C-terminus of the Fab heavy chain to the N-terminus of the second subunit of the Fc domain, or (ii) the first antigen binding domain is fused at the C-terminus of the Fab heavy chain to the N-terminus of the Fab heavy chain of the second antigen binding domain, the second antigen binding domain is fused at the C-terminus of the Fab heavy chain to the N-terminus of the first subunit of the Fc domain, and the third antigen binding domain is fused at the C-terminus of the Fab heavy chain to the N-terminus of the second subunit of the Fc domain.

The Fab molecules may be fused to the Fc domain or to each other directly or through a peptide linker, comprising one or more amino acids, typically about 2-20 amino acids. Peptide linkers are known in the art and are described herein. In one aspect, said peptide linker is (G$_4$S)$_2$ (SEQ ID NO:147). Another suitable such linker comprises the sequence (G$_4$S)$_4$ (SEQ ID NO:152). Additionally, linkers may comprise (a portion of) an immunoglobulin hinge region. Particularly where a Fab molecule is fused to the N-terminus of an Fc domain subunit, it may be fused via an immunoglobulin hinge region or a portion thereof, with or without an additional peptide linker. In a further aspect, the anti-CD20/anti-CD3 bispecific antibody comprises an Fc domain comprising one or more amino acid substitutions that reduce binding to an Fc receptor and/or effector function. In particular, the anti-CD20/anti-CD3 bispecific antibody comprises an IgG1 Fc domain comprising the amino acid substitutions L234A, L235A and P329G.

In a particular aspect, the anti-CD20/anti-CD3 bispecific antibody comprises a polypeptide that is at least 95%, 96%, 97%, 98%, or 99% identical to the sequence of SEQ ID NO: 455, a polypeptide that is at least 95%, 96%, 97%, 98%, or 99% identical to the sequence of SEQ ID NO: 456, a polypeptide that is at least 95%, 96%, 97%, 98%, or 99% identical to the sequence of SEQ ID NO: 457, and a polypeptide that is at least 95%, 96%, 97%, 98%, or 99% identical to the sequence of SEQ ID NO: 458. In a further particular embodiment, the bispecific antibody comprises a polypeptide sequence of SEQ ID NO: 455, a polypeptide sequence of SEQ ID NO: 456, a polypeptide sequence of SEQ ID NO: 457 and a polypeptide sequence of SEQ ID NO: 458 (CD20 TCB).

Particular bispecific antibodies are described in PCT publication no. WO 2016/020309 A1 or in WO 2015/095392 A1. In a further aspect, the anti-CD20/anti-CD3 bispecific antibody may also comprise a bispecific T cell engager (BITE®). In a further aspect, the anti-CD20/anti-CD3 bispecific antibody is XmAb®13676. In another aspect, the bispecific antibody is REGN1979. In another aspect, the bispecific antibody is FBTA05 (*Lymphomun*).

In another aspect of the invention, the bispecific agonistic CD28 antigen binding molecule of the invention is for use in a method for treating or delaying progression of cancer, wherein the bispecific agonistic CD28 antigen binding molecule is used in combination with an anti-CD20/anti-CD3 bispecific antibody, and additionally they are combined with an agent blocking PD-L1/PD-1 interaction. An agent blocking PD-L1/PD-1 interaction is a PD-L1 binding antagonist or a PD-1 binding antagonist. In particular, the agent blocking PD-L1/PD-1 interaction is an anti-PD-L1 antibody or an anti-PD-1 antibody.

In another aspect, a bispecific agonistic CD28 antigen binding molecule of the invention comprising an antigen binding domain capable of specific binding to MM cell surface antigen may be administered in combination with T-cell activating anti-CD3 bispecific antibodies. In one aspect, the T-cell activating anti-CD3 bispecific antibody is specific for a MM cell surface antigen, in particular it is an anti-GPRC5D/anti-CD3 bispecific antibody.

In one particular aspect, the anti-GPRC5D/anti-CD3 bispecific antibody comprises a polypeptide that is at least 95%, 96%, 97%, 98%, or 99% identical to the sequence of SEQ ID NO: 398, a polypeptide that is at least 95%, 96%, 97%, 98%, or 99% identical to the sequence of SEQ ID NO: 399, a polypeptide that is at least 95%, 96%, 97%, 98%, or 99% identical to the sequence of SEQ ID NO: 404, and a polypeptide that is at least 95%, 96%, 97%, 98%, or 99% identical to the sequence of SEQ ID NO: 405. In a further particular aspect, the bispecific antibody comprises a polypeptide sequence of SEQ ID NO: 398, a polypeptide sequence of SEQ ID NO: 399, a polypeptide sequence of SEQ ID NO: 404 and a polypeptide sequence of SEQ ID NO: 405 (GPRC5D CD3 TCB).

In another aspect, provided is a combination product comprising a bispecific agonistic CD28 antigen binding molecule as described herein and a T-cell activating anti-CD3 bispecific antibody. In one aspect, the T-cell activating anti-CD3 bispecific antibody specific for a tumor-associated antigen is an anti-CEA/anti-CD3 bispecific antibody or an anti-MCSP/anti-CD3 bispecific antibody. In one particular aspect, the T-cell activating anti-CD3 bispecific antibody specific for a tumor-associated antigen is an anti-CEA/anti-CD3 bispecific antibody. In another aspect, the T-cell activating anti-CD3 bispecific antibody specific for a tumor-associated antigen is an anti-CD20/anti-CD3 bispecific antibody. In a further aspect, the T-cell activating anti-CD3 bispecific antibody specific for a tumor-associated antigen is an anti-GPRC5D/anti-CD3 bispecific antibody.

Combination with Agents Blocking PD-L1/PD-1 Interaction

In one aspect, the bispecific agonistic CD28 antigen binding molecules of the invention may be administered in combination with agents blocking PD-L1/PD-1 interaction such as a PD-L1 binding antagonist or a PD-1 binding antagonist, in particular an anti-PD-L1 antibody or an anti-PD-1 antibody.

In one aspect, the agent blocking PD-L1/PD-1 interaction is an anti-PD-L1 antibody. The term "PD-L1", also known as CD274 or B7-H1, refers to any native PD-L1 from any vertebrate source, including mammals such as primates (e.g. humans) non-human primates (e.g. cynomolgus monkeys) and rodents (e.g. mice and rats), in particular to "human PD-L1". The amino acid sequence of complete human PD-L1 is shown in UniProt (world wide web uniprot.org) accession no. Q9NZQ7 (SEQ ID NO:459). The term "PD-L1 binding antagonist" refers to a molecule that decreases, blocks, inhibits, abrogates or interferes with signal transduction resulting from the interaction of PD-L1 with either one or more of its binding partners, such as PD-1, B7-1. In some aspects, a PD-L1 binding antagonist is a molecule that inhibits the binding of PD-L1 to its binding partners. In a specific aspect, the PD-L1 binding antagonist inhibits binding of PD-L1 to PD-1 and/or B7-1. In some aspects, the PD-L1 binding antagonists include anti-PD-L1 antibodies, antigen binding fragments thereof, immunoadhesins, fusion proteins, oligopeptides and other molecules that decrease, block, inhibit, abrogate or interfere with signal transduction resulting from the interaction of PD-L1 with one or more of its binding partners, such as PD-1, B7-1. In one aspect, a PD-L1 binding antagonist reduces the negative co-stimulatory signal mediated by or through cell surface proteins expressed on T lymphocytes mediated signaling through PD-L1 so as to render a dysfunctional T-cell less dysfunctional (e.g., enhancing effector responses to antigen recognition). In particular, a PD-L1 binding antagonist is an anti-PD-L1 antibody. The term "anti-PD-L1 antibody" or "antibody binding to human PD-L1" or "antibody that specifically binds to human PD-L1" or "antagonistic anti-PD-L1" refers to an antibody specifically binding to the human PD-L1 antigen with a binding affinity of KD-value of $1.0 \times 10^{-8}$ mol/l or lower, in one aspect of a KD-value of $1.0 \times 10^{-9}$ mol/l or lower. The binding affinity is determined with a standard binding assay, such as surface plasmon resonance technique (BIAcore®, GE-Healthcare Uppsala, Sweden). In a particular aspect, the agent blocking PD-L1/PD-1 interaction is an anti-PD-L1 antibody. In a specific aspect, the anti-PD-L1 antibody is selected from the group consisting of atezolizumab (MPDL3280A, RG7446), durvalumab (MEDI4736), avelumab (MSB0010718C) and MDX-1105. In a specific aspect, an anti-PD-L1 antibody is YW243.55.S70 described herein. In another specific aspect, an anti-PD-L1 antibody is MDX-1105 described herein. In still another specific aspect, an anti-PD-L1 antibody is MEDI4736 (durvalumab). In yet a further aspect, an anti-PD-L1 antibody is MSB0010718C (avelumab). More particularly, the agent blocking PD-L1/PD-1 interaction is atezolizumab (MPDL3280A). In another aspect, the agent blocking PD-L1/PD-1 interaction is an anti-PD-L1 antibody comprising a heavy chain variable domain VH(PDL-1) of SEQ ID NO:460 and a light chain variable domain VL(PDL-1) of SEQ ID NO:461. In another aspect, the agent blocking PD-L1/PD-1 interaction is an anti-PD-L1 antibody comprising a heavy chain variable domain VH(PDL-1) of SEQ ID NO:462 and a light chain variable domain VL(PDL-1) of SEQ ID NO:463.

The term "PD-1", also known as CD279, PD1 or programmed cell death protein 1, refers to any native PD-L1 from any vertebrate source, including mammals such as primates (e.g. humans) non-human primates (e.g. cynomolgus monkeys) and rodents (e.g. mice and rats), in particular to the human protein PD-1 with the amino acid sequence as shown in UniProt (world wide web.uniprot.org) accession no. Q15116 (SEQ ID NO:464). The term "PD-1 binding antagonist" refers to a molecule that inhibits the binding of PD-1 to its ligand binding partners. In some embodiments, the PD-1 binding antagonist inhibits the binding of PD-1 to PD-L1. In some embodiments, the PD-1 binding antagonist inhibits the binding of PD-1 to PD-L2. In some embodiments, the PD-1 binding antagonist inhibits the binding of PD-1 to both PD-L1 and PD-L2. In particular, a PD-L1 binding antagonist is an anti-PD-L1 antibody. The term "anti-PD-1 antibody" or "antibody binding to human PD-1" or "antibody that specifically binds to human PD-1" or "antagonistic anti-PD-1" refers to an antibody specifically binding to the human PD1 antigen with a binding affinity of KD-value of $1.0 \times 10^{-8}$ mol/l or lower, in one aspect of a KD-value of $1.0 \times 10^{-9}$ mol/l or lower. The binding affinity is determined with a standard binding assay, such as surface plasmon resonance technique (BIAcore®, GE-Healthcare Uppsala, Sweden). In one aspect, the agent blocking PD-L1/PD-1 interaction is an anti-PD-1 antibody. In a specific aspect, the anti-PD-1 antibody is selected from the group consisting of MDX 1106 (nivolumab), MK-3475 (pembrolizumab), CT-011 (pidilizumab), MEDI-0680 (AMP-514), PDR001, REGN2810, and BGB-108, in particular from pembrolizumab and nivolumab. In another aspect, the agent blocking PD-L1/PD-1 interaction is an anti-PD-1 antibody comprising a heavy chain variable domain VH(PD-1) of SEQ ID NO:465 and a light chain variable domain VL(PD-1) of SEQ ID NO:466. In another aspect, the agent blocking PD-L1/PD-1 interaction is an anti-PD-1 antibody comprising a heavy chain variable domain VH(PD-1) of SEQ ID NO:467 and a light chain variable domain VL(PD-1) of SEQ ID NO:468.

In another aspect, provided is a combination product comprising a bispecific agonistic CD28 antigen binding molecule as described herein and an agents blocking PD-L1/PD-1 interaction such as a PD-L1 binding antagonist or a PD-1 binding antagonist, in particular an anti-PD-L1 antibody or an anti-PD-1 antibody.

Such combination therapies noted above encompass combined administration (where two or more therapeutic agents are included in the same or separate formulations), and separate administration, in which case, administration of the therapeutic agent can occur prior to, simultaneously, and/or following, administration of an additional therapeutic agent or agents. In one embodiment, administration of the therapeutic agent and administration of an additional therapeutic agent occur within about one month, or within about one, two or three weeks, or within about one, two, three, four, five, or six days, of each other.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper that is pierceable by a hypodermic injection needle). At least one active agent in the composition is a bispecific agonistic CD28 antigen binding molecule of the invention. The label or package insert indicates that the composition is used for treating the condition of choice. Moreover, the article of manufacture may comprise (a) a first container with a composition contained therein, wherein the composition comprises a bispecific agonistic CD28 antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

TABLE B (Sequences):

| SEQ ID NO: | Name | Sequence |
|---|---|---|
| 1 | hu CD28 | UniProt no. P10747, version 1 |
| 2 | hu FAP | UniProt no. Q12884, version 168 |
| 3 | hu CEA | UniProt accession no. P06731 |
| 4 | FAP (28H1) CDR-H1 | SHAMS |
| 5 | FAP (28H1) CDR-H2 | AIWASGEQYYADSVKG |
| 6 | FAP (28H1) CDR-H3 | GWLGNFDY |
| 7 | FAP (28H1) CDR-L1 | RASQSVSRSYLA |
| 8 | FAP (28H1) CDR-L2 | GASTRAT |
| 9 | FAP (28H1) CDR-L3 | QQGQVIPPT |
| 10 | FAP(28H1) VH | EVQLLESGGGLVQPGGSLRLSCAASGFTFSSHAMSWVRQAPGKGL EWVSAIWASGEQYYADSVKGRFTISRDNSKNTLYLQMNSLRAEDT AVYYCAKGWLGNFDYWGQGTLVTVSS |
| 11 | FAP(28H1) VL | EIVLTQSPGTLSLSPGERATLSCRASQSVSRSYLAWYQQKPGQAP RLLIIGASTRATGIPDRFSGSGSGTDFTLTISRLEPEDFAVYYCQ QGQVIPPTFGQGTKVEIK |
| 12 | FAP(4B9) CDR-H1 | SYAMS |
| 13 | FAP(4B9) CDR-H2 | AIIGSGASTYYADSVKG |
| 14 | FAP(4B9) CDR-H3 | GWFGGFNY |
| 15 | FAP(4B9) CDR-L1 | RASQSVTSSYLA |

TABLE B-continued (Sequences):

| SEQ ID NO: | Name | Sequence |
|---|---|---|
| 16 | FAP(4B9) CDR-L2 | VGSRRAT |
| 17 | FAP(4B9) CDR-L3 | QQGIMLPPT |
| 18 | FAP(4B9) VH | EVQLLESGGGLVQPGGSLRLSCAASGFTFSSYAMSWVRQAPGKGL EWVSAIIGSGASTYYADSVKGRFTISRDNSKNTLYLQMNSLRAED TAVYYCAKGWFGGFNYWGQGTLVTVSS |
| 19 | FAP(4B9) VL | EIVLTQSPGTLSLSPGERATLSCRASQSVTSSYLAWYQQKPGQAP RLLINVGSRRATGIPDRFSGSGSGTDFTLTISRLEPEDFAVYYCQ QGIMLPPTFGQGTKVEIK |
| 20 | CD28(SA) CDR-H1 | SYYIH |
| 21 | CD28(SA) CDR-H2 | CIYPGNVNTNYNEKFKD |
| 22 | CD28(SA) CDR-H3 | SHYGLDWNFDV |
| 23 | CD28(SA) CDR-L1 | HASQNIYVWLN |
| 24 | CD28(SA) CDR-L2 | KASNLHT |
| 25 | CD28(SA) CDR-L3 | QQGQTYPYT |
| 26 | CD28(SA) VH | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSS |
| 27 | CD28(SA) VL | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIK |
| 28 | CD28(mAb 9.3) CDR-H1 | DYGVH |
| 29 | CD28(mAb 9.3) CDR-H2 | VIWAGGGTNYNSALMS |
| 30 | CD28(mAb 9.3) CDR-H3 | DKGYSYYYSMDY |
| 31 | CD28(mAb 9.3) CDR-L1 | RASESVEYYVTSLMQ |
| 32 | CD28(mAb 9.3) CDR-L2 | AASNVES |
| 33 | CD28(mAb 9.3) CDR-L3 | QQSRKVPYT |
| 34 | CD28(mAb 9.3) VH | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSS |
| 35 | CD28(mAb 9.3) VL | DIELTQSPASLAVSLGQRATISCRASESVEYYVTSLMQWYQQKPG QPPKLLIFAASNVESGVPARFSGSGSGTNFSLNIHPVDEDDVAMY FCQQSRKVPYTFGGGTKLEIK |
| 36 | CD28 CDR-H1 consensus | SYYIH |
| 37 | CD28 CDR-H2 consensus | SIYPX$_1$X$_2$X$_3$X$_4$TNYNEKFKD, wherein<br>X$_1$ is G or R<br>X$_2$ is N or D<br>X$_3$ is V or G<br>X$_4$ is N or Q or A |
| 38 | CD28 CDR-H3 consensus | SHYGX$_5$DX$_6$NFDV, wherein<br>X$_5$ is L or A<br>X$_6$ is W or H or Y or F |
| 39 | CD28 CDR-L1 consensus | X$_7$ASQX$_8$IX$_9$X$_{10}$X$_{11}$LN, wherein<br>X$_7$ is H or R<br>X$_8$ is N or G |

TABLE B-continued (Sequences):

| SEQ ID NO: | Name | Sequence |
|---|---|---|
| | | $X_9$ is Y or S<br>$X_{10}$ is V or N<br>$X_{11}$ is W or H or F or Y |
| 40 | CD28 CDR-L2 consensus | $X_{12}X_{13}SX_{14}LX_{15}X_{16}$, wherein<br>$X_{12}$ is K or Y<br>$X_{13}$ is A or T<br>$X_{14}$ is N or S<br>$X_{15}$ is H or Y<br>$X_{16}$ is T or S |
| 41 | CD28 CDR-L3 consensus | QQX$_{17}$QTYPYT, wherein<br>$X_{17}$ is G or A |
| 42 | CD28 VH variant a | QVQLVQSGAEVKKPGASVKVSCKASGYTFTSYYIHWVRQAPGQGLEWIGS<br>IYPGNVNTNYNEKFKDRATLTVDTSISTAYMELSRLRSDDTAVYFCTRSH<br>YGLDWNFDVWGQGTTVTVSS |
| 43 | CD28 VH variant b | QVQLVQSGAEVKKPGASVKVSCKASGYTFTSYYIHWVRQAPGQGLEWIGS<br>IYPGNVQTNYNEKFKDRATLTVDTSISTAYMELSRLRSDDTAVYFCTRSH<br>YGLDHNFDVWGQGTTVTVSS |
| 44 | CD28 VH variant c | QVQLVQSGAEVKKPGASVKVSCKASGYTFTSYYIHWVRQAPGQGLEWIGS<br>IYPGNVQTNYNEKFKDRATLTVDTSISTAYMELSRLRSDDTAVYFCTRSH<br>YGADHNFDVWGQGTTVTVSS |
| 45 | CD28 VH variant d | QVQLVQSGAEVKKPGASVKVSCKASGYTFTSYYIHWVRQAPGQGLEWIGS<br>IYPRDGQTNYNEKFKDRATLTVDTSISTAYMELSRLRSDDTAVYFCTRSH<br>YGLDYNFDVWGQGTTVTVSS |
| 46 | CD28 VH variant e | QVQLVQSGAEVKKPGASVKVSCKASGYTFTSYYIHWVRQAPGQGLEWIGS<br>IYPGNVQTNYNEKFKDRATLTVDTSISTAYMELSRLRSDDTAVYFCTRSH<br>YGLDWNFDVWGQGTTVTVSS |
| 47 | CD28 VH variant f | QVQLVQSGAEVKKPGASVKVSCKASGYTFTSYYIHWVRQAPGQGLEWIGS<br>IYPGNVQTNYNEKFKDRATLTVDTSISTAYMELSRLRSDDTAVYFCTRSH<br>YGLDFNFDVWGQGTTVTVSS |
| 48 | CD28 VH variant g | QVQLVQSGAEVKKPGASVKVSCKASGYTFTSYYIHWVRQAPGQGLEWIGS<br>IYPRNVQTNYNEKFKDRATLTVDTSISTAYMELSRLRSDDTAVYFCTRSH<br>YGLDHNFDVWGQGTTVTVSS |
| 49 | CD28 VH variant h | QVQLVQSGAEVKKPGASVKVSCKASGYTFTSYYIHWVRQAPGQGLEWIGS<br>IYPRDVQTNYNEKFKDRATLTVDTSISTAYMELSRLRSDDTAVYFCTRSH<br>YGLDHNFDVWGQGTTVTVSS |
| 50 | CD28 VH variant i | EVQLVESGGGLVQPGGSLRLSCAASGFTFTSYYIHWVRQAPGKGLEWVAS<br>IYPGNVNTRYADSVKGRFTISADTSKNTAYLQMNSLRAEDTAVYYCTRSH<br>YGLDWNFDVWGQGTTVTVSS |
| 51 | CD28 VH variant j | EVQLVESGGGLVQPGGSLRLSCAASGFTFTSYYIHWVRQAPGKGLEWVAS<br>IYPGNVATRYADSVKGRFTISADTSKNTAYLQMNSLRAEDTAVYYCTRSH<br>YGLDWNFDVWGQGTTVTVSS |
| 52 | CD28 VL variant k | DIQMTQSPSSLSASVGDRVTITCHASQNIYVHLNWYQQKPGKAPKLLIYK<br>ASNLHTGVPSRFSGSGSGTDFTLTISSLQPEDFATYYCQQAQTYPYTFGG<br>GTKVEIK |
| 53 | CD28 VL variant l | DIQMTQSPSSLSASVGDRVTITCHASQNIYVFLNWYQQKPGKAPKLLIYK<br>ASNLHTGVPSRFSGSGSGTDFTLTISSLQPEDFATYYCQQGQTYPYTFGG<br>GTKVEIK |
| 54 | CD28 VL variant m | DIQMTQSPSSLSASVGDRVTITCHASQNIYVYLNWYQQKPGKAPKLLIYK<br>ASNLHTGVPSRFSGSGSGTDFTLTISSLQPEDFATYYCQQGQTYPYTFGG<br>GTKVEIK |
| 55 | CD28 VL variant n | DIQMTQSPSSLSASVGDRVTITCHASQGISNYLNWYQQKPGKAPKLLIYK<br>ASNLHTGVPSRFSGSGSGTDFTLTISSLQPEDFATYYCQQGQTYPYTFGG<br>GTKVEIK |
| 56 | CD28 VL variant o | DIQMTQSPSSLSASVGDRVTITCHASQNIYVWLNWYQQKPGKAPKLLIYY<br>TSSLHSGVPSRFSGSGSGTDFTLTISSLQPEDFATYYCQQGQTYPYTFGG<br>GTKVEIK |
| 57 | CD28 VL variant p | DIQMTQSPSSLSASVGDRVTITCHASQGISNYLNWYQQKPGKAPKLLIYY |

TABLE B-continued (Sequences):

| SEQ ID NO: | Name | Sequence |
|---|---|---|
| | | TSSLHSGVPSRFSGSGSGTDFTLTISSLQPEDFATYYCQQGQTYPYTFGG GTKVEIK |
| 58 | CD28 VL variant q | DIQMTQSPSSLSASVGDRVTITCHASQGISNHLNWYQQKPGKAPKLLIYK ASNLHTGVPSRFSGSGSGTDFTLTISSLQPEDFATYYCQQGQTYPYTFGG GTKVEIK |
| 59 | CD28 VL variant r | DIQMTQSPSSLSASVGDRVTITCHASQGIYVYLNWYQQKPGKAPKLLIYK ASNLHTGVPSRFSGSGSGTDFTLTISSLQPEDFATYYCQQGQTYPYTFGG GTKVEIK |
| 60 | CD28 VL variant s | DIQMTQSPSSLSASVGDRVTITCHASQGISVYLNWYQQKPGKAPKLLIYK ASNLHTGVPSRFSGSGSGTDFTLTISSLQPEDFATYYCQQGQTYPYTFGG GTKVEIK |
| 61 | CD28 VL variant t | DIQMTQSPSSLSASVGDRVTITCRASQNIYVWLNWYQQKPGKAPKLLIYK ASNLYSGVPSRFSGSRSGTDFTLTISSLQPEDFATYYCQQGQTYPYTFGQ GTKLEIK |
| 62 | CD28(SA) light chain | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 63 | CD28(SA) hu IgG4 heavy chain | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPCS RSTSESTAALGCLVKDYFPEPVTVSWNSGALTSGVHTFPAVLQSS GLYSLSSVVTVPSSSLGTKTYTCNVDHKPSNTKVDKRVESKYGPP CPSCPAPEFLGGPSVFLFPPKPKDTLMISRTPEVTCVVVDVSQED PEVQFNWYVDGVEVHNAKTKPREEQFNSTYRVVSVLTVLHQDWLN GKEYKCKVSNKGLPSSIEKTISKAKGQPREPQVYTLPPSQEEMTK NQVSLTCLVKGFYPSDIAVEWESNGQPENNYKTTPPVLDSDGSFF LYSRLTVDKSRWQEGNVFSCSVMHEALHNHYTQKSLSLSLGK |
| 64 | CD28(SA) hu IgG1 PGLALA heavy chain | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 65 | VL-CD28(SA)-CL"RK" | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 66 | CD28(SA) hu IgG1 PGLALA Fc knob | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 67 | FAP(4B9) VL-CH hu IgG1 PGLALA Fc hole | EIVLTQSPGTLSLSPGERATLSCRASQSVTSSYLAWYQQKPGQAP RLLINVGSRRATGIPDRFSGSGSGTDFTLTISRLEPEDFAVYYCQ QGIMLPPTFGQGTKVEIKSSASTKGPSVFPLAPSSKSTSGGTAAL GCLVKDYFPEPVTVSWNSGALTSGVHTFPAVLQSSGLYSLSSVVT VPSSSLGTQTYICNVNHKPSNTKVDKKVEPKSCDKTHTCPPCPAP EAAGGPSVFLFPPKPKDTLMISRTPEVTCVVVDVSHEDPEVKFNW YVDGVEVHNAKTKPREEQYNSTYRVVSVLTVLHQDWLNGKEYKCK VSNKALGAPIEKTISKAKGQPREPQVCTLPPSRDELTKNQVSLSC AVKGFYPSDIAVEWESNGQPENNYKTTPPVLDSDGSFFLVSKLTV DKSRWQQGNVFSCSVMHEALHNHYTQKSLSLSP |

TABLE B-continued (Sequences):

| SEQ ID NO: | Name | Sequence |
|---|---|---|
| 68 | FAP(4B9) VH-Ckappa | EVQLLESGGGLVQPGGSLRLSCAASGETFSSYAMSWVRQAPGKGL EWVSAIIGSGASTYYADSVKGRFTISRDNSKNTLYLQMNSLRAED TAVYYCAKGWFGGFNYWGQGTLVTVSSASVAAPSVFIFPPSDEQL KSGTASVVCLLNNFYPREAKVQWKVDNALQSGNSQESVTEQDSKD STYSLSSTLTLSKADYEKHKVYACEVTHQGLSSPVTKSFNRGEC |
| 69 | CD28(SA) VHCH-VHCH Fc knob FAP(4B9) VH PGLALA | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDG GGGSGGGGSQVQLVQSGAEVKKPGASVKVSCKASGYTFTSYYIHW VRQAPGQGLEWIGCIYPGNVNTNYNEKFKDRATLTVDTSISTAYM ELSRLRSDDTAVYFCTRSHYGLDWNFDVWGQGTTVTVSSASTKGP SVFPLAPSSKSTSGGTAALGCLVKDYFPEPVTVSWNSGALTSGVH TFPAVLQSSGLYSLSSVVTVPSSSLGTQTYICNVNHKPSNTKVDK KVEPKSCDKTHTCPPCPAPEAAGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALGAPIEKTISKAKGQPREPQV YTLPPCRDELTKNQVSLWCLVKGFYPSDIAVEWESNGQPENNYKT TPPVLDSDGSFFLYSKLTVDKSRWQQGNVFSCSVMHEALHNHYTQ KSLSLSPGGGGGSGGGGSGGGGSGGGGSEVQLLESGGGLVQPGGS LRLSCAASGFTFSSYAMSWVRQAPGKGLEWVSAIIGSGASTYYAD SVKGRFTISRDNSKNTLYLQMNSLRAEDTAVYYCAKGWFGGFNYW GQGTLVTVSS |
| 70 | CD28(SA) VHCH-VHCH Fc hole FAP(4B9) VL PGLALA | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDG GGGSGGGGSQVQLVQSGAEVKKPGASVKVSCKASGYTFTSYYIHW VRQAPGQGLEWIGCIYPGNVNTNYNEKFKDRATLTVDTSISTAYM ELSRLRSDDTAVYFCTRSHYGLDWNFDVWGQGTTVTVSSASTKGP SVFPLAPSSKSTSGGTAALGCLVKDYFPEPVTVSWNSGALTSGVH TFPAVLQSSGLYSLSSVVTVPSSSLGTQTYICNVNHKPSNTKVDK KVEPKSCDKTHTCPPCPAPEAAGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALGAPIEKTISKAKGQPREPQV CTLPPSRDELTKNQVSLSCAVKGFYPSDIAVEWESNGQPENNYKT TPPVLDSDGSFFLVSKLTVDKSRWQQGNVFSCSVMHEALHNHYTQ KSLSLSPGGGGGSGGGGSGGGGSGGGGSEIVLTQSPGTLSLSPGE RATLSCRASQSVTSSYLAWYQQKPGQAPRLLINVGSRRATGIPDR FSGSGSGTDFTLTISRLEPEDFAVYYCQQGIMLPPTFGQGTKVEI K |
| 71 | CD28(SA) VHCH- Fc knob FAP(4B9) VH | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS S |
| 72 | CD28(SA) VHCH- Fc hole FAP(4B9) VL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFFLVSKLTVDKSRWQQGNVFSCSVMHEALHNHYTQKSLSLSPGG GGGSGGGGSGGGGSGGGGSEIVLTQSPGTLSLSPGERATLSCRAS QSVTSSYLAWYQQKPGQAPRLLINVGSRRATGIPDRFSGSGSGTD FTLTISRLEPEDFAVYYCQQGIMLPPTFGQGTKVEIK |

TABLE B-continued (Sequences):

| SEQ ID NO: | Name | Sequence |
|---|---|---|
| 73 | CD28(SA) VHCH "EE"- Fc PGLALA FAP(4B9) VHCL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS SASVAAPSVFIFPPSDEQLKSGTASVVCLLNNFYPREAKVQWKVD NALQSGNSQESVTEQDSKDSTYSLSSTLTLSKADYEKHKVYACEV THQGLSSPVTKSFNRGEC |
| 74 | FAP(4B9) VLCH1 | EIVLTQSPGTLSLSPGERATLSCRASQSVTSSYLAWYQQKPGQAP RLLINVGSRRATGIPDRFSGSGSGTDFTLTISRLEPEDFAVYYCQ QGIMLPPTFGQGTKVEIKSSASTKGPSVFPLAPSSKSTSGGTAAL GCLVKDYFPEPVTVSWNSGALTSGVHTFPAVLQSSGLYSLSSVVT VPSSSLGTQTYICNVNHKPSNTKVDKKVEPKSCD |
| 75 | CD28(SA) VLCH1- FAP(4B9) VHCH1 "EE"- Fc knob PGLALA | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDGGGGSGGGGSEV QLLESGGGLVQPGGSLRLSCAASGFTFSSYAMSWVRQAPGKGLEW VSAIIGSGASTYYADSVKGRFTISRDNSKNTLYLQMNSLRAEDTA VYYCAKGWFGGFNYWGQGTLVTVSSASTKGPSVFPLAPSSKSTSG GTAALGCLVEDYFPEPVTVSWNSGALTSGVHTFPAVLQSSGLYSL SSVVTVPSSSLGTQTYICNVNHKPSNTKVDEKVEPKSCDKTHTCP PCPAPEAAGGPSVFLFPPKPKDTLMISRTPEVTCVVVDVSHEDPE VKFNWYVDGVEVHNAKTKPREEQYNSTYRVVSVLTVLHQDWLNGK EYKCKVSNKALGAPIEKTISKAKGQPREPQVYTLPPCRDELTKNQ VSLWCLVKGFYPSDIAVEWESNGQPENNYKTTPPVLDSDGSFFLY SKLTVDKSRWQQGNVFSCSVMHEALHNHYTQKSLSLSP |
| 76 | FAP(4B9) VHCH1 "EE"- Fc hole PGLALA | EVQLLESGGGLVQPGGSLRLSCAASGFTFSSYAMSWVRQAPGKGL EWVSAIIGSGASTYYADSVKGRFTISRDNSKNTLYLQMNSLRAED TAVYYCAKGWFGGFNYWGQGTLVTVSSASTKGPSVFPLAPSSKST SGGTAALGCLVEDYFPEPVTVSWNSGALTSGVHTFPAVLQSSGLY SLSSVVTVPSSSLGTQTYICNVNHKPSNTKVDEKVEPKSCDKTHT CPPCPAPEAAGGPSVFLFPPKPKDTLMISRTPEVTCVVVDVSHED PEVKFNWYVDGVEVHNAKTKPREEQYNSTYRVVSVLTVLHQDWLN GKEYKCKVSNKALGAPIEKTISKAKGQPREPQVCTLPPSRDELTK NQVSLSCAVKGFYPSDIAVEWESNGQPENNYKTTPPVLDSDGSFF LVSKLTVDKSRWQQGNVFSCSVMHEALHNHYTQKSLSLSP |
| 77 | CD28(SA) VHCL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASVAAPSVFIFPPSD EQLKSGTASVVCLLNNFYPREAKVQWKVDNALQSGNSQESVTEQD SKDSTYSLSSTLTLSKADYEKHKVYACEVTHQGLSSPVTKSFNRG EC |
| 78 | FAP(4B9) VLCL "RK" | EIVLTQSPGTLSLSPGERATLSCRASQSVTSSYLAWYQQKPGQAP RLLINVGSRRATGIPDRFSGSGSGTDFTLTISRLEPEDFAVYYCQ QGIMLPPTFGQGTKVEIKRTVAAPSVFIFPPSDRKLKSGTASVVC LLNNFYPREAKVQWKVDNALQSGNSQESVTEQDSKDSTYSLSSTL TLSKADYEKHKVYACEVTHQGLSSPVTKSFNRGEC |
| 79 | Fc hole PGLALA | DKTHTCPPCPAPEAAGGPSVFLFPPKPKDTLMISRTPEVTCVVVD VSHEDPEVKFNWYVDGVEVHNAKTKPREEQYNSTYRVVSVLTVLH QDWLNGKEYKCKVSNKALGAPIEKTISKAKGQPREPQVCTLPPSR DELTKNQVSLSCAVKGFYPSDIAVEWESNGQPENNYKTTPPVLDS DGSFFLVSKLTVDKSRWQQGNVFSCSVMHEALHNHYTQKSLSLSP |
| 80 | Fc knob -FAP(4B9) VH | DKTHTCPPCPAPEAAGGPSVFLFPPKPKDTLMISRTPEVTCVVVD VSHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GGGGSGGGGSGGGGSGGGGSEVQLLESGGGLVQPGGSLRLSCAA |

TABLE B-continued (Sequences):

| SEQ ID NO: | Name | Sequence |
|---|---|---|
| | | SGFTFSSYAMSWVRQAPGKGLEWVSAIIGSGASTYYADSVKGRFT ISRDNSKNTLYLQMNSLRAEDTAVYYCAKGWFGGFNYWGQGTLVT VSS |
| 81 | CD28(SA) VHCH1 "EE"- Fc PGLALA CEA VHCL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLVESGGGLVQPGRSLRLSCAASG FTVSSYWMHWVRQAPGKGLEWVGFIRNKANGGTTEYAASVKGRFT ISRDDSKNTLYLQMNSLRAEDTAVYYCARDRGLRFYFDYWGQGTT VTVSSASVAAPSVFIFPPSDEQLKSGTASVVCLLNNFYPREAKVQ WKVDNALQSGNSQESVTEQDSKDSTYSLSSTLTLSKADYEKHKVY ACEVTHQGLSSPVTKSFNRGEC |
| 82 | CEAVLCH1 | QAVLTQPASLSASPGASASLTCTLRRGINVGAYSIYWYQQKPGSP PQYLLRYKSDSDKQQGSGVSSRFSASKDASANAGILLISGLQSED EADYYCMIWHSGASAVFGGGTKLTVLSSASTKGPSVFPLAPSSKS TSGGTAALGCLVKDYFPEPVTVSWNSGALTSGVHTFPAVLQSSGL YSLSSVVTVPSSSLGTQTYICNVNHKPSNTKVDKKVEPKSC |
| 83 | CD28(SA) VHCH1- Fc knob CEA VH | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLVESGGGLVQPGRSLRLSCAASG FTVSSYWMHWVRQAPGKGLEWVGFIRNKANGGTTEYAASVKGRFT ISRDDSKNTLYLQMNSLRAEDTAVYYCARDRGLRFYFDYWGQGTT VTVSS |
| 84 | CD28(SA) VHCH1- Fc hole CEA VL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFFLVSKLTVDKSRWQQGNVFSCSVMHEALHNHYTQKSLSLSPGG GGGSGGGGSGGGGSGGGGSQAVLTQPASLSASPGASASLTCTLRR GINVGAYSIYWYQQKPGSPPQYLLRYKSDSDKQQGSGVSSRFSAS KDASANAGILLISGLQSEDEADYYCMIWHSGASAVFGGGTKLTVL |
| 85 | CD28(SA) VHCH1 "EE"- Fc hole PGLALA HYRF | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFELVSKLTVDKSRWQQGNVFSCSVMHEALHNRFTQKSLSLSP |
| 86 | Fc knob PGLALA | DKTHTCPPCPAPEAAGGPSVFLFPPKPKDTLMISRTPEVTCVVVD VSHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP |
| 87 | CEA VL-CH1 hu IgG1 PGLALA Fc hole | QAVLTQPASLSASPGASASLTCTLRRGINVGAYSIYWYQQKPGSP PQYLLRYKSDSDKQQGSGVSSRFSASKDASANAGILLISGLQSED |

TABLE B-continued (Sequences):

| SEQ ID NO: | Name | Sequence |
|---|---|---|
| | | EADYYCMIWHSGASAVFGGGTKLTVLSSASTKGPSVFPLAPSSKS TSGGTAALGCLVKDYFPEPVTVSWNSGALTSGVHTFPAVLQSSGL YSLSSVVTVPSSSLGTQTYICNVNHKPSNTKVDKKVEPKSCDKTH TCPPCPAPEAAGGPSVFLFPPKPKDTLMISRTPEVTCVVVDVSHE DPEVKFNWYVDGVEVHNAKTKPREEQYNSTYRVVSVLTVLHQDWL NGKEYKCKVSNKALGAPIEKTISKAKGQPREPQVCTLPPSRDELT KNQVSLSCAVKGFYPSDIAVEWESNGQPENNYKTTPPVLDSDGSF FLVSKLTVDKSRWQQGNVFSCSVMHEALHNHYTQKSLSLSP |
| 88 | CEAVH-CL | EVQLVESGGGLVQPGRSLRLSCAASGFTVSSYWMHWVRQAPGKGL EWVGFIRNKANGGTTEYAASVKGRFTISRDDSKNTLYLQMNSLRA EDTAVYYCARDRGLRFYFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| 89 | CD28(mAb 9.3) light chain | DIELTQSPASLAVSLGQRATISCRASESVEYYVTSLMQWYQQKPG QPPKLLIFAASNVESGVPARFSGSGSGTNFSLNIHPVDEDDVAMY FCQQSRKVPYTFGGGTKLEIKRTVAAPSVFIFPPSDEQLKSGTAS VVCLLNNFYPREAKVQWKVDNALQSGNSQESVTEQDSKDSTYSLS STLTLSKADYEKHKVYACEVTHQGLSSPVTKSFNRGEC |
| 90 | CD28(mAb 9.3) hu IgG1 PGLALA heavy chain | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSP |
| 91 | CD28(mAb 9.3) hu IgG light chain "RK" | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGK |
| 92 | CD28(mAb 9.3) hu IgG1 PGLALA Fc knob "EE" | DIELTQSPASLAVSLGQRATISCRASESVEYYVTSLMQWYQQKPG QPPKLLIFAASNVESGVPARFSGSGSGTNFSLNIHPVDEDDVAMY FCQQSRKVPYTFGGGTKLEIKRTVAAPSVFIFPPSDRKLKSGTAS VVCLLNNFYPREAKVQWKVDNALQSGNSQESVTEQDSKDSTYSLS STLTLSKADYEKHKVYACEVTHQGLSSPVTKSFNRGEC |
| 93 | CD28(mAb 9.3) VHCH-VHCH Fc knob FAP(4B9) VH PGLALA | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDG GGGSGGGGSEVKLQQSGPGLVTPSQSLSITCTVSGFSLSDYGVHW VRQSPGQGLEWLGVIWAGGGTNYNSALMSRKSISKDNSKSQVFLK MNSLQADDTAVYYCARDKGYSYYYSMDYWGQGTSVTVSSASTKGP SVFPLAPSSKSTSGGTAALGCLVKDYFPEPVTVSWNSGALTSGVH TFPAVLQSSGLYSLSSVVTVPSSSLGTQTYICNVNHKPSNTKVDK KVEPKSCDKTHTCPPCPAPEAAGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALGAPIEKTISKAKGQPREPQV YTLPPCRDELTKNQVSLWCLVKGFYPSDIAVEWESNGQPENNYKT TPPVLDSDGSFFLYSKLTVDKSRWQQGNVFSCSVMHEALHNHYTQ KSLSLSPGGGGSGGGGSGGGGSGGGGSEVQLLESGGGLVQPGGS LRLSCAASGFTFSSYAMSWVRQAPGKGLEWVSAIIGSGASTYYAD SVKGRFTISRDNSKNTLYLQMNSLRAEDTAVYYCAKGWFGGFNYW GQGTLVTVSS |
| 94 | CD28(mAb 9.3) VHCH-VHCH Fc hole FAP(4B9) VL PGLALA | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDG |

TABLE B-continued (Sequences):

| SEQ ID NO: | Name | Sequence |
|---|---|---|
| | | GGGSGGGGSEVKLQQSGPGLVTPSQSLSITCTVSGFSLSDYGVHW VRQSPGQGLEWLGVIWAGGGTNYNSALMSRKSISKDNSKSQVFLK MNSLQADDTAVYYCARDKGYSYYYSMDYWGQGTSVTVSSASTKGP SVFPLAPSSKSTSGGTAALGCLVKDYFPEPVTVSWNSGALTSGVH TFPAVLQSSGLYSLSSVVTVPSSSLGTQTYICNVNHKPSNTKVDK KVEPKSCDKTHTCPPCPAPEAAGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALGAPIEKTISKAKGQPREPQV CTLPPSRDELTKNQVSLSCAVKGFYPSDIAVEWESNGQPENNYKT TPPVLDSDGSFFLVSKLTVDKSRWQQGNVFSCSVMHEALHNHYTQ KSLSLSPGGGGSGGGGSGGGGSGGGGSEIVLTQSPGTLSLSPGE RATLSCRASQSVTSSYLAWYQQKPGQAPRLLINVGSRRATGIPDR FSGSGSGTDFTLTISRLEPEDFAVYYCQQGIMLPPTFGQGTKVEI K |
| 95 | CD28 (mAb 9.3) VHCH- Fc knob FAP(4B9) VH | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS S |
| 96 | CD28 (mAb 9.3) VHCH- Fc hole FAP(4B9) VL | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFELVSKLTVDKSRWQQGNVFSCSVMHEALHNHYTQKSLSLSPGG GGGSGGGGSGGGGSGGGGSEIVLTQSPGTLSLSPGERATLSCRAS QSVTSSYLAWYQQKPGQAPRLLINVGSRRATGIPDRFSGSGSGTD FTLTISRLEPEDFAVYYCQQGIMLPPTFGQGTKVEIK |
| 97 | CD28 (mAb 9.3) VHCH "EE"- Fc PGLALA FAP(4B9) VHCL | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS SASVAAPSVFIFPPSDEQLKSGTASVVCLLNNFYPREAKVQWKVD NALQSGNSQESVTEQDSKDSTYSLSSTLTLSKADYEKHKVYACEV THQGLSSPVTKSFNRGEC |
| 98 | CD28 (mAb 9.3) VLCL "RK" | DIELTQSPASLAVSLGQRATISCRASESVEYYVTSLMQWYQQKPG QPPKLLIFAASNVESGVPARFSGSGSGTNFSLNIHPVDEDDVAMY FCQQSRKVPYTFGGGTKLEIKRTVAAPSVFIFPPSDRKLKSGTAS VVCLLNNFYPREAKVQWKVDNALQSGNSQESVTEQDSKDSTYSLS STLTLSKADYEKHKVYACEVTHQGLSSPVTKSFNRGEC |
| 99 | FAP (4B9) VLCH1 | EIVLTQSPGTLSLSPGERATLSCRASQSVTSSYLAWYQQKPGQAP RLLINVGSRRATGIPDRFSGSGSGTDFTLTISRLEPEDFAVYYCQ QGIMLPPTFGQGTKVEIKSSKSTSGGTAALGCLVKDYFPEPVTVSWNSGALTSGVHTFPAVLQSSGLYSLSSVVT VPSSSLGTQTYICNVNHKPSNTKVDKKVEPKSC |
| 100 | CD28 (mAb 9.3) VLCH1- FAP(4B9) | DIELTQSPASLAVSLGQRATISCRASESVEYYVTSLMQWYQQKPG QPPKLLIFAASNVESGVPARFSGSGSGTNFSLNIHPVDEDDVAMY |

TABLE B-continued (Sequences):

| SEQ ID NO: | Name | Sequence |
|---|---|---|
| | VHCH1 "EE"- Fc knob PGLALA | FCQQSRKVPYTFGGGTKLEIKSSASTKGPSVFPLAPSSKSTSGGT AALGCLVKDYFPEPVTVSWNSGALTSGVHTFPAVLQSSGLYSLSS VVTVPSSSLGTQTYICNVNHKPSNTKVDKKVEPKSCDGGGGSGGG GSEVQLLESGGGLVQPGGSLRLSCAASGFTFSSYAMSWVRQAPGK GLEWVSAIIGSGASTYYADSVKGRFTISRDNSKNTLYLQMNSLRA EDTAVYYCAKGWFGGFNYWGQGTLVTVSSASTKGPSVFPLAPSSK STSGGTAALGCLVEDYFPEPVTVSWNSGALTSGVHTFPAVLQSSG LYSLSSVVTVPSSSLGTQTYICNVNHKPSNTKVDEKVEPKSCDKT HTCPPCPAPEAAGGPSVFLFPPKPKDTLMISRTPEVTCVVVDVSH EDPEVKFNWYVDGVEVHNAKTKPREEQYNSTYRVVSVLTVLHQDW LNGKEYKCKVSNKALGAPIEKTISKAKGQPREPQVYTLPPCRDEL TKNQVSLWCLVKGFYPSDIAVEWESNGQPENNYKTTPPVLDSDGS FFLYSKLTVDKSRWQQGNVFSCSVMHEALHNHYTQKSLSLSP |
| 101 | CD28 (mAb 9.3) VHCL | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASVAAPSVFIFPPSD EQLKSGTASVVCLLNNFYPREAKVQWKVDNALQSGNSQESVTEQD SKDSTYSLSSTLTLSKADYEKHKVYACEVTHQGLSSPVTKSFNRG EC |
| 102 | CD28 (mAb 9.3) VHCH1 "EE"- Fc PGLALA CEA VHCL | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLVESGGGLVQPGRSLRLSCAASG FTVSSYWMHWVRQAPGKGLEWVGFIRNKANGGTTEYAASVKGRFT ISRDDSKNTLYLQMNSLRAEDTAVYYCARDRGLRFYFDYWGQGTT VTVSSASVAAPSVFIFPPSDEQLKSGTASVVCLLNNFYPREAKVQ WKVDNALQSGNSQESVTEQDSKDSTYSLSSTLTLSKADYEKHKVY ACEVTHQGLSSPVTKSFNRGEC |
| 103 | CD28 (mAb 9.3) VHCH1- Fc knob CEA VH | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLVESGGGLVQPGRSLRLSCAASG FTVSSYWMHWVRQAPGKGLEWVGFIRNKANGGTTEYAASVKGRFT ISRDDSKNTLYLQMNSLRAEDTAVYYCARDRGLRFYFDYWGQGTT VTVSS |
| 104 | CD28 (mAb 9.3) VHCH1- Fc hole CEA VL | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFFLVSKLTVDKSRWQQGNVFSCSVMHEALHNHYTQKSLSLSPGG GGGSGGGGSGGGGSGGGGSQAVLTQPASLSASPGASASLTCTLRR GINVGAYSIYWYQQKPGSPPQYLLRYKSDSDKQQGSGVSSRFSAS KDASANAGILLISGLQSEDEADYYCMIWHSGASAVFGGGGTKLTVL |
| 105 | CD28 (mAb 9.3) VHCH1 "EE"- Fc hole PGLALA HYRF | EVKLQQSGPGLVTPSQSLSITCTVSGFSLSDYGVHWVRQSPGQGL EWLGVIWAGGGTNYNSALMSRKSISKDNSKSQVFLKMNSLQADDT AVYYCARDKGYSYYYSMDYWGQGTSVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE |

TABLE B-continued (Sequences):

| SEQ ID NO: | Name | Sequence |
|---|---|---|
| | | LTKNQVSLSCAVKGFYPSDIAVEWESNGQPENNYKTTPPVLDSDG SFFLVSKLTVDKSRWQQGNVFSCSVMHEALHNHYTQKSLSLSP |
| 106 | CD28(mAb 9.3) VLCL "RK" | DIELTQSPASLAVSLGQRATISCRASESVEYYVTSLMQWYQQKPG QPPKLLIFAASNVESGVPARFSGSGSGTNFSLNIHPVDEDDVAMY FCQQSRKVPYTFGGGTKLEIKRTVAAPSVFIFPPSDRKLKSGTAS VVCLLNNFYPREAKVQWKVDNALQSGNSQESVTEQDSKDSTYSLS STLTLSKADYEKHKVYACEVTHQGLSSPVTKSFNRGEC |
| 107 | CD28(SA) VHCH1 "EE" Fc hole PGLALA FAP(4B9) VH - CEA(Medi-565) VHCL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS SGGGGSGGGGSGGGGSGGGGSEVQLVESGGGLVQPGRSLRLSCAA SGFTVSSYWMHWVRQAPGKGLEWVGFIRNKANGGTTEYAASVKGR FTISRDDSKNTLYLQMNSLRAEDTAVYYCARDRGLRFYFDYWGQG TTVTVSSASVAAPSVFIFPPSDEQLKSGTASVVCLLNNFYPREAK VQWKVDNALQSGNSQESVTEQDSKDSTYSLSSTLTLSKADYEKHK VYACEVTHQGLSSPVTKSFNRGEC |
| 108 | CD28(SA) VHCH1 "EE" Fc knob PGLALA FAP(4B9) VL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE LTKNQVSLSCAVKGFYPSDIAVEWESNGQPENNYKTTPPVLDSDG SFFLVSKLTVDKSRWQQGNVFSCSVMHEALHNHYTQKSLSLSPGG GGGSGGGGSGGGGSGGGGSEIVLTQSPGTLSLSPGERATLSCRAS QSVTSSYLAWYQQKPGQAPRLLINVGSRRATGIPDRFSGSGSGTD FTLTISRLEPEDFAVYYCQQGIMLPPTFGQGTKVEIK |
| 109 | CEA VLCH1 | QAVLTQPASLSASPGASASLTCTLRRGINVGAYSIYWYQQKPGSP PQYLLRYKSDSDKQQGSGVSSRFSASKDASANAGILLISGKQSED EADYYCMIWHSGASAVFGGGTKLTVLSSASTKGPSVFPLAPSSKS TSGGTAALGCLVKDYFPEPVTVSWNSGALTSGVHTFPAVLQSSGL YSLSSVVTVPSSSLGTQTYICNVNHKPSNTKVDKKVEPKSC |
| 110 | CD28(SA) VHCH1 Fc hole PGLALA FAP(4B9) VH - CEA VH | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSPGG GGGSGGGGSGGGGSGGGGSEVQLLESGGGLVQPGGSLRLSCAASG FTFSSYAMSWVRQAPGKGLEWVSAIIGSGASTYYADSVKGRFTIS RDNSKNTLYLQMNSLRAEDTAVYYCAKGWFGGFNYWGQGTLVTVS SGGGGSGGGGSGGGGSGGGGSEVQLVESGGGLVQPGRSLRLSCAA SGFTVSSYWMHWVRQAPGKGLEWVGFIRNKANGGTTEYAASVKGR FTISRDDSKNTLYLQMNSLRAEDTAVYYCARDRGLRFYFDYWGQG TTVTVSS |
| 111 | CD28(SA) VHCH1 Fc knob PGLALA FAP(4B9) VL- CEA VL | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVCTLPPSRDE |

TABLE B-continued (Sequences):

| SEQ ID NO: | Name | Sequence |
|---|---|---|
| | | LTKNQVSLSCAVKGFYPSDIAVEWESNGQPENNYKTTPPVLDSDG SFFLVSKLTVDKSRWQQGNVFSCSVMHEALHNHYTQKSLSLSPGG GGGSGGGGSGGGGSGGGGSEIVLTQSPGTLSLSPGERATLSCRAS QSVTSSYLAWYQQKPGQAPRLLINVGSRRATGIPDRFSGSGSGTD FTLTISRLEPEDFAVYYCQQGIMLPPTFGQGTKVEIKGGGGSGGGG GSGGGGSGGGGSQAVLTQPASLSASPGASASLTCTLRRGINVGAY SIYWYQQKPGSPPQYLLRYKSDSDKQQGSGVSSRFSASKDASANA GILLISGLQSEDEADYYCMIWHSGASAVFGGGTKLTVL |
| 112 | VH (CD28 SA) CH1 (EE)- Fc knob PGLALA | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 113 | VH (CD28 variant g) CH1 (EE) - Fc knob PGLALA | QVQLVQSGAEVKKPGASVKVSCKASGYTFTSYYIHWVRQAPGQGL EWIGSIYPRNVQTNYNEKFKDRATLTVDTSISTAYMELSRLRSDD TAVYFCTRSHYGLDHNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 114 | VH (CD28 variant f) CH1 (EE) - Fc knob PGLALA | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDFNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 115 | VH (CD28 variant j) CH1 (EE) - Fc knob PGLALA | EVQLVESGGGLVQPGGSLRLSCAASGFTFTSYYIHWVRQAPGKGL EWVASIYPGNVATRYADSVKGRFTISADTSKNTAYLQMNSLRAED TAVYYCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 116 | VH (CD28 variant e) CH1 (EE)- Fc knob PGLALA | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 117 | VH (CD28 variant b) CH1 (EE) - Fc knob PGLALA | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDHNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |

TABLE B-continued (Sequences):

| SEQ ID NO: | Name | Sequence |
|---|---|---|
| 118 | VH (CD28 variant a) CH1 (EE) - Fc knob PGLALA | QVQLVQSGAEVKKPGASVKVSCKASGYTFTSYYIHWVRQAPGQGL EWIGSIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 119 | VH (CD28 variant i) CH1 (EE) - Fc knob PGLALA | EVQLVESGGGLVQPGGSLRLSCAASGFTFTSYYIHWVRQAPGKGL EWVASIYPGNVNTRYADSVKGRFTISADTSKNTAYLQMNSLRAED TAVYYCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 120 | VL (CD28 variant k)- CL (RK) | DIQMTQSPSSLSASVGDRVTITCHASQNIYVHLNWYQQKPGKAPK LLIYKASNLHTGVPSRFSGSGSGTDFTLTISSLQPEDFATYYCQQ AQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 121 | VL (CD28 variant l)-CL (RK) | DIQMTQSPSSLSASVGDRVTITCHASQNIYVFLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 122 | VL (CD28 variant m)- CL (RK) | DIQMTQSPSSLSASVGDRVTITCHASQNIYVYLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 123 | VL (CD28 variant r)-CL (RK) | DIQMTQSPSSLSASVGDRVTITCHASQGIYVYLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 124 | VL (CD28 variant s)- CL (RK) | DIQMTQSPSSLSASVGDRVTITCHASQGISVYLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 125 | VL (CD28 variant t)-CL (RK) | DIQMTQSPSSLSASVGDRVTITCRASQNIYVWLNWYQQKPGKAPK LLIYKASNLYSGVPSRFSGSRSGTDFTLTISSLQPEDFATYYCQQ GQTYPYTFGQGTKLEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 126 | Fc hole PGLALA, HYRF | DKTHTCPPCPAPEAAGGPSVFLFPPKPKDTLMISRTPEVTCVVVD VSHEDPEVKFNWYVDGVEVHNAKTKPREEQYNSTYRVVSVLTVLH QDWLNGKEYKCKVSNKALGAPIEKTISKAKGQPREPQVCTLPPSR DELTKNQVSLSCAVKGFYPSDIAVEWESNGQPENNYKTTPPVLDS DGSFFLVSKLTVDKSRWQQGNVFSCSVMHEALHNRFTQKSLSLSP |
| 127 | CEA CDR-H1 | SYWMH |
| 128 | CEA CDR-H2 | FIRNKANGGTTEYAASVKG |
| 129 | CEA CDR-H3 | DRGLRFYFDY |
| 130 | CEA CDR-L1 | TLRRGINVGAYSTY |
| 131 | CEA CDR-L2 | YKSDSDKQQGSGV |
| 132 | CEA CDR-L3 | MIWHSGASAV |

TABLE B-continued (Sequences):

| SEQ ID NO: | Name | Sequence |
|---|---|---|
| 133 | CEA VH | EVQLVESGGGLVQPGRSLRLSCAASGFTVSSYWMHWVRQAPGKGL EWVGFIRNKANGGTTEYAASVKGRFTISRDDSKNTLYLQMNSLRA EDTAVYYCARDRGLRFYFDYWGQGTTVTVSS |
| 134 | CEA VL | QAVLTQPASLSASPGASASLTCTLRRGINVGAYSIYWYQQKPGSP PQYLLRYKSDSDKQQGSGVSSRFSASKDASANAGILLISGLQSED EADYYCMIWHSGASAVFGGGTKLTVL |
| 135 | His-tagged human FAP ECD | RPSRVHNSEENTMRALTLKDILNGTFSYKTFFPNWISGQEYLHQS ADNNIVLYNIETGQSYTILSNRTMKSVNASNYGLSPDRQFVYLES DYSKLWRYSYTATYYIYDLSNGEFVRGNELPRPIQYLCWSPVGSK LAYVYQNNIYLKQRPGDPPFQITFNGRENKIFNGIPDWVYEEEML ATKYALWWSPNGKFLAYAEFNDTDIPVIAYSYYGDEQYPRTINTP YPKAGAKNPVVRIFIIDTTYPAYVGPQEVPVPAMIASSDYYFSWL TWVTDERVCLQWLKRVQNVSVLSICDFREDWQTWDCPKTQEHIEE SRTGWAGGFFVSTPVFSYDAISYYKIFSDKDGYKHIHYIKDTVEN AIQITSGKWEAINIFRVTQDSLFYSSNEFEEYPGRRNIYRISIGS YPPSKKCVTCHLRKERCQYYTASFSDYAKYYALVCYGPGIPISTL HDGRTDQEIKILEENKELENALKNIQLPKEEIKKLEVDEITLWYK MILPPQFDRSKKYPLLIQVYGGPCSQSVRSVFAVNWISYLASKEG MVIALVDGRGTAFQGDKLLYAVYRKLGVYEVEDQITAVRKFIEMG FIDEKRIAIWGWSYGGYVSSLALASGTGLFKCGIAVAPVSSWEYY ASVYTERFMGLPTKDDNLEHYKNSTVMARAEYFRNVDYLLIHGTA DDNVHFQNSAQIAKALVNAQVDFQAMWYSDQNHGLSGLSTNHLYT HMTHFLKQCFSLSDGKKKKKKGHHHHHH |
| 136 | mouse FAP | UniProt accession no. P97321 |
| 137 | His-tagged mouse FAP RAD | RPSRVYKPEGNTKRALTLKDILNGTFSYKTYFPNWISEQEYLHQS EDDNIVFYNIETRESYIILSNSTMKSVNATDYGLSPDRQFVYLES DYSKLWRYSYTATYYIYDLQNGEFVRGYELPRPIQYLCWSPVGSK LAYVYQNNIYLKQRPGDPPFQITYTGRENRIFNGIPDWVYEEEML ATKYALWWSPDGKFLAYVEFNDSDIPIIAYSYYGDGQYPRTINIP YPKAGAKNPVVRVFIVDTTYPHHVGPMEVPVPEMIASSDYYFSWL TWVSSERVCLQWLKRVQNVSVLSICDFREDWHAWECPKNQEHVEE SRTGWAGGFFVSTPAFSQDATSYYKIFSDKDGYKHIHYIKDTVEN AIQITSGKWEAIYIFRVTQDSLFYSSNEFEGYPGRRNIYRISIGN SPPSKKCVTCHLRKERCQYYTASFSYKAKYYALVCYGPGLPISTL HDGRTDQEIQVLEENKELENSLRNIQLPKVEIKKLKDGGLTFWYK MILPPQFDRSKKYPLLIQVYGGPCSQSVKSVFAVNWITYLASKEG IVIALVDGRGTAFQGDKFLHAVYRKLGVYEVEDQLTAVRKFIEMG FIDEERIAIWGWSYGGYVSSLALASGTGLFKCGIAVAPVSSWEYY ASIYSERFMGLPTKDDNLEHYKNSTVMARAEYFRNVDYLLIHGTA DDNVHFQNSAQIAKALVNAQVDFQAMWYSDQNHGILSGRSQNHLY THMTHFLKQCFSLSDGKKKKKKGHHHHHH |
| 138 | His-tagged cynomolgus FAP ECD | RPPRVHNSEENTMRALTLKDILNGTFSYKTFFPNWISGQEYLHQS ADNNIVLYNIETGQSYTILSNRTMKSVNASNYGLSPDRQFVYLES DYSKLWRYSYTATYYIYDLSNGEFVRGNELPRPIQYLCWSPVGSK LAYVYQNNIYLKQRPGDPPFQITFNGRENKIFNGIPDWVYEEEML ATKYALWWSPNGKFLAYAEFNDTDIPVIAYSYYGDEQYPRTINIP YPKAGAKNPFVRIFIIDTTYPAYVGPQEVPVPAMIASSDYYFSWL TWVTDERVCLQWLKRVQNVSVLSICDFREDWQTWDCPKTQEHIEE SRTGWAGGFFVSTPVFSYDAISYYKIFSDKDGYKHIHYIKDTVEN AIQITSGKWEAINIFRVTQDSLFYSSNEFEDYPGRRNIYRISIGS YPPSKKCVTCHLRKERCQYYTASFSDYAKYYALVCYGPGIPISTL HDGRTDQEIKILEENKELENALKNIQLPKEEIKKLEVDEITLWYK MILPPQFDRSKKYPLLIQVYGGPCSQSVRSVFAVNWISYLASKEG MVIALVDGRGTAFQGDKLLYAVYRKLGVYEVEDQITAVRKFIEMG FIDEKRIAIWGWSYGGYVSSLALASGTGLFKCGIAVAPVSSWEYY ASVYTERFMGLPTKDDNLEHYKNSTVMARAEYFRNVDYLLIHGTA DDNVHFQNSAQIAKALVNAQVDFQAMWYSDQNHGLSGLSTNHLYT HMTHFLKQCFSLSDGKKKKKKGHHHHHH |
| 139 | human FolR1 | UniProt accession no. P15328 |
| 140 | murine FolR1 | UniProt accession no. P35846 |
| 141 | cynomolgus FolR1 | UniProt accession no. G7PR14 |
| 142 | human MCSP | UniProt accession no. Q6UVK1 |
| 143 | human EGFR | UniProt accession no. P00533 |

TABLE B-continued (Sequences):

| SEQ ID NO: | Name | Sequence |
|---|---|---|
| 144 | human HER2 | Uniprot accession no. P04626 |
| 145 | p95 HER2 | MPIWKFPDEEGACQPCPINCTHSCVDLDDKGCPAEQRASPLTSII SAVVGILLVVVLGVVFGILIKRRQQKIRKYTMRRLLQETELVEPL TPSGAMPNQAQMRILKETELRKVKVLGSGAFGTVYKGIWIPDGEN VKIPVAIKVLRENTSPKANKEILDEAYVMAGVGSPYVSRLLGICL TSTVQLVTQLMPYGCLLDHVRENRGRLGSQDLLNWCMQIAKGMSY LEDVRLVHRDLAARNVLVKSPNHVKITDFGLARLLDIDETEYHAD GGKVPIKWMALESILRRRFTHQSDVWSYGVTVWELMTFGAKPYDG IPAREIPDLLEKGERLPQPPICTIDVYMIMVKCWMIDSECRPRFR ELVSEFSRMARDPQRFVVIQNEDLGPASPLDSTFYRSLLEDDDMG DLVDAEEYLVPQQGFFCPDPAPGAGGMVHHRHRSSSTRSGGGDLT LGLEPSEEEAPRSPLAPSEGAGSDVFDGDLGMGAAKGLQSLPTHD PSPLQRYSEDPTVPLPSETDGYVAPLTCSPQPEYVNQPDVRPQPP SPREGPLPAARPAGATLERPKTLSPGKNGVVKDVFAFGGAVENPE YLTPQGGAAPQPHPPPAFSPAFDNLYYWDQDPPERGAPPSTFKGT PTAENPEYLGLDVPV |
| 146 | Peptide linker (G4S) | GGGGS |
| 147 | Peptide linker (G4S)2 | GGGGSGGGGS |
| 148 | Peptide linker (SG4)2 | SGGGGSGGGG |
| 149 | Peptide linker G4(SG4)2 | GGGGSGGGGSGGGG |
| 150 | peptide linker | GSPGSSSSGS |
| 151 | (G4S)3 peptide linker | GGGGSGGGGSGGGGS |
| 152 | (G4S)4 peptide linker | GGGGSGGGGSGGGGSGGGGS |
| 153 | peptide linker | GSGSGSGS |
| 154 | peptide linker | GSGSGNGS |
| 155 | peptide linker | GGSGSGSG |
| 156 | peptide linker | GGSGSG |
| 157 | peptide linker | GGSG |
| 158 | peptide linker | GGSGNGSG |
| 159 | peptide linker | GGNGSGSG |
| 160 | peptide linker | GGNGSG |
| 161 | Light chain "CEA 2F1" (CEA TCB) | DIQMTQSPSSLSASVGDRVTITCKASAAVGTYVAWYQQKPGKAPK LLIYSASYRKRGVPSRFSGSGSGTDFTLTISSLQPEDFATYYCHQ YYTYPLFTFGQGTKLEIKRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC |
| 162 | Light Chain humanized CD3 CH2527 (Crossfab, VL-CH1) (CEA TCB) | QAVVTQEPSLTVSPGGTVTLTCGSSTGAVTTSNYANWVQEKPGQA FRGLIGGTNKRAPGTPARFSGSLLGGKAALTLSGAQPEDEAEYYC ALWYSNLWVFGGGTKLTVLSSASTKGPSVFPLAPSSKSTSGGTAA LGCLVKDYFPEPVTVSWNSGALTSGVHTFPAVLQSSGLYSLSSVV TVPSSSLGTQTYICNVNHKPSNTKVDKKVEPKSC |
| 163 | CEA CH1A1A 98/99 - humanized CD3 CH2527 (Crossfab VH-Ck)- Fc(knob) P329GLALA (CEA TCB) | QVQLVQSGAEVKKPGASVKVSCKASGYTFTEFGMNWVRQAPGQGL EWMGWINTKTGEATYVEEFKGRVTFTTDTSTSTAYMELRSLRSDD TAVYYCARWDFAYYVEAMDYWGQGTTVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKKVEPKSCD GGGGSGGGGSEVQLLESGGGLVQPGGSLRLSCAASGFTFSTYAMN WVRQAPGKGLEWVSRIRSKYNNYATYYADSVKGRFTISRDDSKNT LYLQMNSLRAEDTAVYYCVRHGNFGNSYVSWFAYWGQGTLVTVSS ASVAAPSVFIFPPSDEQLKSGTASVVCLLNNFYPREAKVQWKVDN ALQSGNSQESVTEQDSKDSTYSLSSTLTLSKADYEKHKVYACEVT HQGLSSPVTKSFNRGECDKTHTCPPCPAPEAAGGPSVFLFPPKPK DTLMISRTPEVTCVVVDVSHEDPEVKFNWYVDGVEVHNAKTKPRE EQYNSTYRVVSVLTVLHQDWLNGKEYKCKVSNKALGAPIEKTISK AKGQPREPQVYTLPPCRDELTKNQVSLWCLVKGFYPSDIAVEWES |

TABLE B-continued (Sequences):

| SEQ ID NO: | Name | Sequence |
|---|---|---|
| | | NGQPENNYKTTPPVLDSDGSFFLYSKLTVDKSRWQQGNVFSCSVM<br>HEALHNHYTQKSLSLSP |
| 164 | CEA $_{CH1A1A\ 98/99}$ (VH-CH1)-Fc(hole) P329GLALA (CEA TCB) | QVQLVQSGAEVKKPGASVKVSCKASGYTFTEFGMNWVRQAPGQGL<br>EWMGWINTKTGEATYVEEFKGRVTFTTDTSTSTAYMELRSLRSDD<br>TAVYYCARWDFAYYVEAMDYWGQGTTVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKKVEPKSCD<br>KTHTCPPCPAPEAAGGPSVFLFPPKPKDTLMISRTPEVTCVVVDV<br>SHEDPEVKFNWYVDGVEVHNAKTKPREEQYNSTYRVVSVLTVLHQ<br>DWLNGKEYKCKVSNKALGAPIEKTISKAKGQPREPQVCTLPPSRD<br>ELTKNQVSLSCAVKGFYPSDIAVEWESNGQPENNYKTTPPVLDSD<br>GSFFLVSKLTVDKSRWQQGNVFSCSVMHEALHNHYTQKSLSLSP |
| 165 | CD3 VH-CL (CEACAM5 TCB) | EVQLLESGGGLVQPGGSLRLSCAASGFTFSTYAMNWVRQAPGKGL<br>EWVSRIRSKYNNYATYYADSVKGRFTISRDDSKNTLYLQMNSLRA<br>EDTAVYYCVRHGNFGNSYVSWFAYWGQGTLVTVSSASVAAPSVFI<br>FPPSDEQLKSGTASVVCLLNNFYPREAKVQWKVDNALQSGNSQES<br>VTEQDSKDSTYSLSSTLTLSKADYEKHKVYACEVTHQGLSSPVTK<br>SFNRGEC |
| 166 | humanized CEA VH-CH1(EE)-Fc (hole, P329G LALA) (CEACAM5 TCB) | QVQLVQSGAEVKKPGSSVKVSCKASGFNIKDTYMHWVRQAPGQGL<br>EWMGRIDPANGNSKYVPKFQGRVTITADTSTSTAYMELSSLRSED<br>TAVYYCAPFGYYVSDYAMAYWGQGTLVTVSSASTKGPSVFPLAPS<br>SKSTSGGTAALGCLVEDYFPEPVTVSWNSGALTSGVHTFPAVLQS<br>SGLYSLSSVVTVPSSSLGTQTYICNVNHKPSNTKVDEKVEPKSCD<br>KTHTCPPCPAPEAAGGPSVFLFPPKPKDTLMISRTPEVTCVVVDV<br>SHEDPEVKFNWYVDGVEVHNAKTKPREEQYNSTYRVVSVLTVLHQ<br>DWLNGKEYKCKVSNKALGAPIEKTISKAKGQPREPQVCTLPPSRD<br>ELTKNQVSLSCAVKGFYPSDIAVEWESNGQPENNYKTTPPVLDSD<br>GSFFLVSKLTVDKSRWQQGNVFSCSVMHEALHNHYTQKSLSLSP |
| 167 | humanized CEA VH-CH1(EE)-CD3 VL-CH1-Fc (knob, P329G LALA) (CEACAM5 TCB) | QVQLVQSGAEVKKPGSSVKVSCKASGFNIKDTYMHWVRQAPGQGL<br>EWMGRIDPANGNSKYVPKFQGRVTITADTSTSTAYMELSSLRSED<br>TAVYYCAPFGYYVSDYAMAYWGQGTLVTVSSASTKGPSVFPLAPS<br>SKSTSGGTAALGCLVEDYFPEPVTVSWNSGALTSGVHTFPAVLQS<br>SGLYSLSSVVTVPSSSLGTQTYICNVNHKPSNTKVDEKVEPKSCD<br>GGGGSGGGGSQAVVTQEPSLTVSPGGTVTLTCGSSTGAVTTSNYA<br>NWVQEKPGQAFRGLIGGTNKRAPGTPARFSGSLLGGKAALTLSGA<br>QPEDEAEYYCALWYSNLWVFGGGTKLTVLSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKKVEPKSCD<br>KTHTCPPCPAPEAAGGPSVFLFPPKPKDTLMISRTPEVTCVVVDV<br>SHEDPEVKFNWYVDGVEVHNAKTKPREEQYNSTYRVVSVLTVLHQ<br>DWLNGKEYKCKVSNKALGAPIEKTISKAKGQPREPQVYTLPPCRD<br>ELTKNQVSLWCLVKGFYPSDIAVEWESNGQPENNYKTTPPVLDSD<br>GSFFLYSKLTVDKSRWQQGNVFSCSVMHEALHNHYTQKSLSLSP |
| 168 | humanized CEA VL-CL(RK) (CEACAM5 TCB) | EIVLTQSPATLSLSPGERATLSCRAGESVDIFGVGFLHWYQQKPG<br>QAPRLLIYRASNRATGIPARFSGSGSGTDFTLTISSLEPEDFAVY<br>YCQQTNEDPYTFGQGTKLEIKRTVAAPSVFIFPPSDRKLKSGTAS<br>VVCLLNNFYPREAKVQWKVDNALQSGNSQESVTEQDSKDSTYSLS<br>STLTLSKADYEKHKVYACEVTHQGLSSPVTKSFNRGEC |
| 169 | CEACAM5-based antigen Hu N(A2-B2)A-avi-His | QLTTESMPFNVAEGKEVLLLVHNLPQQLFGYSWYKGERVDGNRQI<br>VGYAIGTQQATPGPANSGRETIYPNASLLIQNVTQNDTGFYTLQV<br>IKSDLVNEEATGQFHVYPELPKPPITSNNSNPVEDEDAVALTCEP<br>EIQNTTYLWWVNNQSLPVSPRLQLSNDNRTLTLLSVTRNDVGPYE<br>CGIQNKLSVDHSDPVILNVLYGPDDPTISPSYTYYRPGVNLSLSC<br>HAASNPPAQYSWLIDGNIQQHTQELFISNITEKNSGLYTCQANNS<br>ASGHSRTTVKTITVSALSPVVAKPQIKASKTTVTGDKDSVNLTCS<br>TNDTGISIRWFFKNQSLPSSERMKLSQGNITLSINPVKREDAGTY<br>WCEVFNPISKNQSDPIMLNVNYNALPQENLINVDGSGLNDIFEAQ<br>KIEWHEARAHHHHHH |
| 170 | CEA (A5B7)- CDR-H1 | DYYMN |
| 171 | CEA (A5B7)- CDR-H2 | FIGNKANGYTTEYSASVKG |
| 172 | CEA (A5B7)- CDR-H3 | DRGLRFYFDY |
| 173 | CEA (A5B7)- CDR-L1 | RASSSVTYIH |
| 174 | CEA (A5B7)- CDR-L2 | ATSNLAS |

TABLE B-continued (Sequences):

| SEQ ID NO: | Name | Sequence |
|---|---|---|
| 175 | CEA (A5B7)- CDR-L3 | QHWSSKPPT |
| 176 | IgG1 Fc knob PGLALA | APEAAGGPSVFLFPPKPKDTLMISRTPEVTCVVVDVSHEDPEVKF NWYVDGVEVHNAKTKPREEQYNSTYRVVSVLTVLHQDWLNGKEYK CKVSNKALGAPIEKTISKAKGQPREPQVYTLPPCRDELTKNQVSL WCLVKGFYPSDIAVEWESNGQPENNYKTTPPVLDSDGSFFLYSKL TVDKSRWQQGNVFSCSVMHEALHNHYTQKSLSLSP |
| 177 | IgG1 Fc hole PGLALA | APEAAGGPSVFLFPPKPKDTLMISRTPEVTCVVVDVSHEDP EVKFNWYVDGVEVHNAKTKPREEQYNSTYRVVSVLTVLHQD WLNGKEYKCKVSNKALGAPIEKTISKAKGQPREPQVCTLPP SRDELTKNQVSLSCAVKGFYPSDIAVEWESNGQPENNYKTT PPVLDSDGSFFLVSKLTVDKSRWQQGNVESCSVMHEALHNH YTQKSLSLSP |
| 178 | CEA (A5B7) VH (parental) | EVKLVESGGGLVQPGGSLRLSCATSGFTFTDYYMNWVRQPP GKALEWLGFIGNKANGYTTEYSASVKGRFTISRDKSQSILY LQMNTLRAEDSATYYCTRDRGLRFYFDYWGQGTTLTVSS |
| 179 | CEA (A5B7) VL (parental) | QTVLSQSPAILSASPGEKVTMTCRASSSVTYIHWYQQKPGS SPKSWIYATSNLASGVPARFSGSGSGTSYSLTISRVEAEDA ATYYCQHWSSKPPTFGGGTKLEIK |
| 180 | CEA (A5H1EL1D)- CDR-H1 | GFTFTDYYMN |
| 181 | CEA (A5H1EL1D)- CDR-H2 | FIGNKANAYTTEYSASVKG |
| 182 | CEA (A5H1EL1D)- CDR-H3 | DRGLRFYFDY |
| 183 | CEA (A5H1EL1D)- CDR-L1 | RASSSVTYIH |
| 184 | CEA (A5H1EL1D)- CDR-L2 | ATSNLAS |
| 185 | CEA (A5H1EL1D)- CDR-L3 | QHWSSKPPT |
| 186 | CEA (A5H1EL1D) VH (3-23A5-1E) | EVQLLESGGGLVQPGGSLRLSCAASGFTFTDYYMNWVRQAP GKGLEWLGFIGNKANAYTTEYSASVKGRFTISRDKSKNTLY LQMNSLRAEDTATYYCTRDRGLRFYFDYWGQGTTVTVSS |
| 187 | CEA (A5H1EL1D) VL (A5-L1D) | EIVLTQSPATLSLSPGERATLSCRASSSVTYIHWYQQKPGQ APRSWIYATSNLASGIPARFSGSGSGTDFTLTISSLEPEDF AVYYCQHWSSKPPTFGQGTKLEIK |
| 188 | CEA (A5H1EL1D aff. mat.) CDR-H1 consensus | GFX$_1$FX$_2$DYX$_3$MN, wherein X$_1$ is T or Y, X$_2$ is T or S, and X$_3$ is Y or A or E |
| 189 | CEA (A5H1EL1D aff. mat.) CDR-H2 consensus | X$_4$IX$_5$NKANAYTTEYSASVKG, wherein X$_4$ is F or V, X$_5$ is G or S |
| 190 | CEA (A5H1EL1D aff. mat.) CDR-H3 consensus | DRGX$_6$RFX$_7$FDY, wherein X$_6$ is L or I, X$_7$ is Y or G or Q or S |
| 191 | CEA (A5H1EL1D aff. mat.) CDR-L1 consensus | X$_8$ASSSVTYTH, wherein X$_8$ is R or H |
| 192 | CEA (A5H1EL1D aff. mat.) CDR-L2 consensus | ATSNLAS |
| 193 | CEA (A5H1EL1D aff. mat.) CDR-L3 consensus | QHWSSX$_9$X$_{10}$PT, wherein X$_9$ is K or V or Q or I, X$_{10}$ is P or S |
| 194 | CEA (P006.038) VH | EVQLLESGGGLVQPGGSLRLSCAASGFTFTDYYMNWV |

TABLE B-continued (Sequences):

| SEQ ID NO: | Name | Sequence |
|---|---|---|
| | | RQAPGKGLEWLGFIGNKANAYTTEYSASVKGRFTISR DKSKNTLYLQMNSLRAEDTATYYCTRDRGIRFGFDYW GQGTTVTVSS |
| 195 | CEA (P006.038) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSVPPTFGQGTKLEIK |
| 196 | CEA (P005.097) VH | EVQLLESGGGLVQPGGSLRLSCAASGFTFTDYYMNWV RQAPGKGLEWLGFIGNKANAYTTEYSASVKGRFTISR DKSKNTLYLQMNSLRAEDTATYYCTRDRGLRFSFDYW GQGTTVTVSS |
| 197 | CEA (P005.097) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSQPPTFGQGTKLEIK |
| 198 | CEA (P005.103) VH | EVQLLESGGGLVQPGGSLRLSCAASGFTFTDYYMNWV RQAPGKGLEWLGFIGNKANAYTTEYSASVKGRFTISR DKSKNTLYLQMNSLRAEDTATYYCTRDRGIRFYFDYW GQGTTVTVSS |
| 199 | CEA (P005.103) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSISPTFGQGTKLEIK |
| 200 | CEA (P002.139) VH | EVQLLESGGGLVQPGGSLRLSCAASGFYFTDYAMNWV RQAPGKGLEWGVISNKANAYTTEYSASVKGRFTISR DKSKNTLYLQMNSLRAEDTATYYCTRDRGLRFYFDYW GQGTTVTVSS |
| 201 | CEA (P002.139) VL | EIVLTQSPATLSLSPGERATLSCHASSSVTYIHWYQQ KPGQAPRSWIYATSNLASGIPARFSGSGSGTDFTLTI SSLEPEDFAVYYCQHWSSKPPTFGQGTKLEIK |
| 202 | CEA (P001.177) VH | EVQLLESGGGLVQPGGSLRLSCAASGFYFTDYYMNWV RQAPGKGLEWLGFISNKANAYTTEYSASVKGRFTISR DKSKNTLYLQMNSLRAEDTATYYCTRDRGLRFYFDYW GQGTTVTVSS |
| 203 | CEA (P001.177) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSKPPTFGQGTKLEIK |
| 204 | CEA (P005.102) VH | EVQLLESGGGLVQPGGSLRLSCAASGFTFTDYYMNWV RQAPGKGLEWLGFIGNKANAYTTEYSASVKGRFTISR DKSKNTLYLQMNSLRAEDTATYYCTRDRGIRFQFDYW GQGTTVTVSS |
| 205 | CEA (P005.102) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSKSPTFGQGTKLEIK |
| 206 | CEA (P005.102 combo1) VH | EVQLLESGGGLVQPGGSLRLSCAASGFYFTDYYMNWV RQAPGKGLEWGVISNKANAYTTEYSASVKGRFTISR DKSKNTLYLQMNSLRAEDTATYYCTRDRGIRFQFDYW GQGTTVTVSS |
| 207 | CEA (P005.102 combo1) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSKSPTFGQGTKLEIK |
| 208 | CEA (P005.102 combo2) VH | EVQLLESGGGLVQPGGSLRLSCAASGFYFSDYYMNWV RQAPGKGLEWGVISNKANAYTTEYSASVKGRFTISR DKSKNTLYLQMNSLRAEDTATYYCTRDRGIRFQFDYW GQGTTVTVSS |
| 209 | CEA (P005.102 combo2) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSKSPTFGQGTKLEIK |
| 210 | CEA (P005.103 combo1) VH | EVQLLESGGGLVQPGGSLRLSCAASGFTFTDYYMNWV RQAPGKGLEWLGFIGNKANAYTTEYSASVKGRFTISR DKSKNTLYLQMNSLRAEDTATYYCTRDRGIRFSFDYW GQGTTVTVSS |

TABLE B-continued (Sequences):

| SEQ ID NO: | Name | Sequence |
|---|---|---|
| 211 | CEA (P005.103 combo1) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSISPTFGQGTKLEIK |
| 212 | CEA (P005.103 combo2) VH | EVQLLESGGGLVQPGGSLRLSCAASGFYFTDYYMNWV RQAPGKGLEWLGVISNKANAYTTEYSASVKGRFTISR DKSKNTLYLQMNSLRAEDTATYYCTRDRGIRFSFDYW GQGTTVTVSS |
| 213 | CEA (P005.103 combo2) VL | EIVLTQSPATLSLSPGERATLSCRASSSVTYIHWYQQKPGQ APRSWIYATSNLASGIPARFSGSGSGTDFTLTISSLEPEDF AVYYCQHWSSISPTFGQGTKLEIK |
| 214 | CEA (P006.038 combo1) VH | EVQLLESGGGLVQPGGSLRLSCAASGFYFTDYAMNWV RQAPGKGLEWLGVISNKANAYTTEYSASVKGRFTISR DKSKNTLYLQMNSLRAEDTATYYCTRDRGIRFGFDYW GQGTTVTVSS |
| 215 | CEA (P006.038 combo1) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSVPPTFGQGTKLEIK |
| 216 | CEA (P006.038 combo2) VH | EVQLLESGGGLVQPGGSLRLSCAASGFTFSDYEMNWV RQAPGKGLEWLGFISNKANAYTTEYSASVKGRFTISR DKSKNTLYLQMNSLRAEDTATYYCTRDRGIRFGFDYW GQGTTVTVSS |
| 217 | CEA (P006.038 combo2) VL | EIVLTQSPATLSLSPGERATLSCRASSSVTYIHWYQQ KPGQAPRSWIYATSNLASGIPARFSGSGSGTDFTLTI SSLEPEDFAVYYCQHWSSVPPTFGQGTKLEIK |
| 218 | IGHV3-23-02 | EVQLLESGGGLVQPGGSLRLSCAASGFTFSSYAMSWVRQAPGKGL EWVSAISGSGGSTYYGDSVKGRFTISRDNSKNTLYLQMNSLRAED TAVYYCAK |
| 219 | IGHV3-15*01 | EVQLVESGGGLVKPGGSLRLSCAASGFTFSNAWMSWVRQAPGKGL EWVGRIKSKTDGGTTDYAAPVKGRFTISRDDSKNTLYLQMNSLKT EDTAVYYCTT |
| 220 | 3-23A5-1 | EVQLLESGGGLVQPGGSLRLSCAASGFTFTDYYMNWVRQAPGKGL EWVGFIGNKANGYTTEYSASVKGRFTISRDNSKNTLYLQMNSLRA EDTAVYYCARDRGLRFYFDYWGQGTTVTVSS |
| 221 | 3-23A5-2 | EVQLLESGGGLVQPGGSLRLSCAASGFTFTDYYMNWVRQAPGKGL EWVGFIGNKANGYTTYYGDSVKGRFTISRDNSKNTLYLQMNSLRA EDTAVYYCARDRGLRFYFDYWGQGTTVTVSS |
| 222 | 3-23A5-3 | EVQLLESGGGLVQPGGSLRLSCAASGFTFTDYYMNWVRQAPGKGL EWVGFIGNKGYTTEYSASVKGRFTISRDNSKNTLYLQMNSLRAED TAVYYCARDRGLRFYFDYWGQGTTVTVSS |
| 223 | 3-23A5-4 | EVQLLESGGGLVQPGGSLRLSCAASGFTFTDYYMSWVRQAPGKGL EWVGFIGNKANGYTTEYSASVKGRFTISRDNSKNTLYLQMNSLRA EDTAVYYCARDRGLRFYFDYWGQGTTVTVSS |
| 224 | 3-23A5-1A (all_backmutations) | EVQLLESGGGLVQPGGSLRLSCAASGFTFTDYYMNWVRQAPGKGL EWLGFIGNKANGYTTEYSASVKGRFTISRDKSKNTLYLQMNSLRA EDTATYYCTRDRGLRFYFDYWGQGTTVTVSS |
| 225 | 3-23A5-1C (A93T) | EVQLLESGGGLVQPGGSLRLSCAASGFTFTDYYMNWVRQAPGKGL EWVGFIGNKANGYTTEYSASVKGRFTISRDNSKNTLYLQMNSLRA EDTAVYYCTRDRGLRFYFDYWGQGTTVTVSS |
| 226 | 3-23A5-1D (K73) | EVQLLESGGGLVQPGGSLRLSCAASGFTFTDYYMNWVRQAPGKGL EWVGFIGNKANGYTTEYSASVKGRFTISRDKSKNTLYLQMNSLRA EDTAVYYCARDRGLRFYFDYWGQGTTVTVSS |
| 227 | 3-15A5-1 | EVQLVESGGGLVKPGGSLRLSCAASGFTFTDYYMNWVRQAPGKGL EWVGFIGNKANGYTTEYSASVKGRFTISRDDSKNTLYLQMNSLKT EDTAVYYCTRDRGLRFYFDYWGQGTTVTVSS |
| 228 | 3-15A5-2 | EVQLVESGGGLVKPGGSLRLSCAASGFTFTDYYMNWVRQAPGKGL EWVGFIGNKANGYTTEYAAPVKGRFTISRDDSKNTLYLQMNSLKT EDTAVYYCTRDRGLRFYFDYWGQGTTVTVSS |

TABLE B-continued (Sequences):

| SEQ ID NO: | Name | Sequence |
|---|---|---|
| 229 | 3-15A5-3 | EVQLVESGGGLVKPGGSLRLSCAASGFTFTDYYMNWVRQAPGKGL EWVGFIGNKANGGTTDYAAPVKGRFTISRDDSKNTLYLQMNSLKT EDTAVYYCTRDRGLRFYFDYWGQGTTVTVSS |
| 230 | IGKV3-11 | EIVLTQSPATLSLSPGERATLSCRASQSVSSYLAWYQQKPGQAPR LLIYDASNRATGIPARFSGSGSGTDFTLTISSLEPEDFAVYYCQQ RSNWP |
| 231 | A5-L1 | EIVLTQSPATLSLSPGERATLSCRASSSVTYIHWYQQKPGQAPRL LIYATSNLASGIPARFSGSGSGTDFTLTISSLEPEDFAVYYCQHW SSKPPTFGQGTKLEIK |
| 232 | A5-L2 | EIVLTQSPATLSLSPGERATLSCRASQSVSSYIHWYQQKPGQAPR LLIYATSNLASGIPARFSGSGSGTDFTLTISSLEPEDFAVYYCQH WSSKPPTFGQGTKLEIK |
| 233 | A5-L3 | EIVLTQSPATLSLSPGERATLSCRASSSVTYIHWYQQKPGQAPRL LIYDASNRATGIPARFSGSGSGTDFTLTISSLEPEDFAVYYCQHW SSKPPTFGQGTKLEIK |
| 234 | A5-L4 | EIVLTQSPATLSLSPGERATLSCRASSSVTYIHWYQQKPGQAPRL LIYATSNLASGIPARFSGSGSGTDFTLTISSLEPEDFAVYYCQQW SSKPPTFGQGTKLEIK |
| 235 | A5-L1A (all_backmutations) | QTVLTQSPATLSLSPGERATLSCRASSSVTYIHWYQQKPGSSPKS WIYATSNLASGIPARFSGSGSGTDYTLTISSLEPEDFAVYYCQHW SSKPPTFGQGTKLEIK |
| 236 | A5-L1B (Q1T2) | QTVLTQSPATLSLSPGERATLSCRASSSVTYIHWYQQKPGQAPRL LIYATSNLASGIPARFSGSGSGTDFTLTISSLEPEDFAVYYCQHW SSKPPTFGQGTKLEIK |
| 237 | A5-L1C (FR2) | EIVLTQSPATLSLSPGERATLSCRASSSVTYIHWYQQKPGSSPKS WIYATSNLASGIPARFSGSGSGTDFTLTISSLEPEDFAVYYCQHW SSKPPTFGQGTKLEIK |
| 238 | NABA-avi-His | See Table 15 |
| 239 | N(A2B2)A-avi-His | See Table 15 |
| 240 | NA(B2)A-avi-His | See Table 15 |
| 241 | A5H1EL1D_H1_rev_TN | See Table 16 |
| 242 | A5H1EL1D_H2_for_TN | See Table 16 |
| 243 | LMB3 long | See Table 16 |
| 244 | HCDR3-rev-constant | See Table 16 |
| 245 | A5H1EL1D_L1_rev_TN | See Table 17 |
| 246 | A5H1EL1D_L2_for_TN | See Table 17 |
| 247 | A5H1EL1D_L3_for_TN | See Table 18 |
| 248 | A5H1EL1D_H3_rev_TN | See Table 18 |
| 249 | LCDR3-rev-constant | See Table 18 |
| 250 | HCDR3 amplification | See Table 18 |
| 251 | CEA (P006.038)-CDR-H1 | See Table 22 |
| 252 | CEA (P006.038)-CDR-H2 | See Table 22 |

TABLE B-continued (Sequences):

| SEQ ID NO: | Name | Sequence |
|---|---|---|
| 253 | CEA (P006.038)-CDR-H3 | See Table 22 |
| 254 | CEA (P006.038)-CDR-L1 | See Table 23 |
| 255 | CEA (P006.038)-CDR-L2 | See Table 23 |
| 256 | CEA (P006.038)-CDR-L3 | See Table 23 |
| 257 | CEA (P005.097)-CDR-H1 | See Table 22 |
| 258 | CEA (P005.097)-CDR-H2 | See Table 22 |
| 259 | CEA (P005.097)-CDR-H3 | See Table 22 |
| 260 | CEA (P005.097)-CDR-L1 | See Table 23 |
| 261 | CEA (P005.097)-CDR-L2 | See Table 23 |
| 262 | CEA (P005.097)-CDR-L3 | See Table 23 |
| 263 | CEA (P005.103)-CDR-H1 | See Table 22 |
| 264 | CEA (P005.103)-CDR-H2 | See Table 22 |
| 265 | CEA (P005.103)-CDR-H3 | See Table 22 |
| 266 | CEA (P005.103)-CDR-L1 | See Table 23 |
| 267 | CEA (P005.103)-CDR-L2 | See Table 23 |
| 268 | CEA (P005.103)-CDR-L3 | See Table 23 |
| 269 | CEA (P002.139)-CDR-H1 | See Table 22 |
| 270 | CEA (P002.139)-CDR-H2 | See Table 22 |
| 271 | CEA (P002.139)-CDR-H3 | See Table 22 |
| 272 | CEA (P002.139)-CDR-L1 | See Table 23 |
| 273 | CEA (P002.139)-CDR-L2 | See Table 23 |
| 274 | CEA (P002.139)-CDR-L3 | See Table 23 |
| 275 | CEA (P001.177)-CDR-H1 | See Table 22 |
| 276 | CEA (P001.177)-CDR-H2 | See Table 22 |
| 277 | CEA (P001.177)-CDR-H3 | See Table 22 |

TABLE B-continued (Sequences):

| SEQ ID NO: | Name | Sequence |
|---|---|---|
| 278 | CEA (P001.177)- CDR-L1 | See Table 23 |
| 279 | CEA (P001.177)- CDR-L2 | See Table 23 |
| 280 | CEA (P001.177)- CDR-L3 | See Table 23 |
| 281 | CEA (P005.102)- CDR-H1 | See Table 22 |
| 282 | CEA (P005.102)- CDR-H2 | See Table 22 |
| 283 | CEA (P005.102)- CDR-H3 | See Table 22 |
| 284 | CEA (P005.102)- CDR-L1 | See Table 23 |
| 285 | CEA (P005.102)- CDR-L2 | See Table 23 |
| 286 | CEA (P005.102)- CDR-L3 | See Table 23 |
| 287 | CEA (P005.102-combo1)- CDR-H1 | See Table 22 |
| 288 | CEA (P005.102-combo1)- CDR-H2 | See Table 22 |
| 289 | CEA (P005.102-combo1)- CDR-H3 | See Table 22 |
| 290 | CEA (P005.102-combo1)- CDR-L1 | See Table 23 |
| 291 | CEA (P005.102-combo1)- CDR-L2 | See Table 23 |
| 292 | CEA (P005.102-combo1)- CDR-L3 | See Table 23 |
| 293 | CEA (P005.102-combo2)- CDR-H1 | See Table 22 |
| 294 | CEA (P005.102-combo2)- CDR-H2 | See Table 22 |
| 295 | CEA (P005.102-combo2)- CDR-H3 | See Table 22 |
| 296 | CEA (P005.102-combo2)- CDR-L1 | See Table 23 |
| 297 | CEA (P005.102-combo2)- CDR-L2 | See Table 23 |
| 298 | CEA (P005.102-combo2)- CDR-L3 | See Table 23 |
| 299 | CEA (P005.103-combo1)- CDR-H1 | See Table 22 |
| 300 | CEA (P005.103-combo1)- CDR-H2 | See Table 22 |
| 301 | CEA (P005.103-combo1)- CDR-H3 | See Table 22 |
| 302 | CEA (P005.103-combo1)- CDR-L1 | See Table 23 |

TABLE B-continued (Sequences):

| SEQ ID NO: | Name | Sequence |
|---|---|---|
| 303 | CEA (P005.103-combo1)- CDR-L2 | See Table 23 |
| 304 | CEA (P005.103-combo1)- CDR-L3 | See Table 23 |
| 305 | CEA (P005.103-combo2)- CDR-H1 | See Table 22 |
| 306 | CEA (P005.103-combo2)- CDR-H2 | See Table 22 |
| 307 | CEA (P005.103-combo2)- CDR-H3 | See Table 22 |
| 308 | CEA (P005.103-combo2)- CDR-L1 | See Table 23 |
| 309 | CEA (P005.103-combo2)- CDR-L2 | See Table 23 |
| 310 | CEA (P005.103-combo2)- CDR-L3 | See Table 23 |
| 311 | CEA (P006.038-combo1)- CDR-H1 | See Table 22 |
| 312 | CEA (P006.038-combo1)- CDR-H2 | See Table 22 |
| 313 | CEA (P006.038-combo1)- CDR-H3 | See Table 22 |
| 314 | CEA (P006.038-combo1)- CDR-L1 | See Table 23 |
| 315 | CEA (P006.038-combo1)- CDR-L2 | See Table 23 |
| 316 | CEA (P006.038-combo1)- CDR-L3 | See Table 23 |
| 317 | CEA (P006.038-combo2)- CDR-H1 | See Table 22 |
| 318 | CEA (P006.038-combo2)- CDR-H2 | See Table 22 |
| 319 | CEA (P006.038-combo2)- CDR-H3 | See Table 22 |
| 320 | CEA (P006.038-combo2)- CDR-L1 | See Table 23 |
| 321 | CEA (P006.038-combo2)- CDR-L2 | See Table 23 |
| 322 | CEA (P006.038-combo2)- CDR-L3 | See Table 23 |
| 323 | VL CEA (A5H1EL1D) -CH1- Fc hole PGLALA | See Table 24 |
| 324 | VH CEA (A5H1EL1D) -CL | See Table 24 |
| 325 | VL CEA (P006.038) - CH1- Fc hole PGLALA | See Table 24 |
| 326 | VH CEA (P006.038) - CL | See Table 24 |
| 327 | VL CEA (P005.097) - CH1- Fc hole PGLALA | See Table 24 |

TABLE B-continued (Sequences):

| SEQ ID NO: | Name | Sequence |
|---|---|---|
| 328 | VH CEA (P005.097) - CL | See Table 24 |
| 329 | VL CEA (P005.103) - CH1- Fc hole PGLALA | See Table 24 |
| 330 | VH CEA (P005.103) - CL | See Table 24 |
| 331 | VL CEA (P002.139) - CH1- Fc hole PGLALA | See Table 24 |
| 332 | VH CEA (P002.139) - CL | See Table 24 |
| 333 | VL CEA (P001.177) - CH1- Fc hole PGLALA | See Table 24 |
| 334 | VH CEA (P001.177) - CL | See Table 24 |
| 335 | VL CEA (P005.102) - CH1- Fc hole PGLALA | See Table 24 |
| 336 | VH CEA (P005.102) - CL | See Table 24 |
| 337 | VL CEA (P005.102 combo1) -CH1- Fc hole PGLALA | See Table 24 |
| 338 | VH CEA (P005.102 combo1) - CL | See Table 24 |
| 339 | VL CEA (P005.102 combo2) -CH1- Fc hole PGLALA | See Table 24 |
| 340 | VH CEA (P005.102 combo2) - CL | See Table 24 |
| 341 | VL CEA (P005.103 combo1) -CH1- Fc hole PGLALA | See Table 24 |
| 342 | VH CEA (P005.103 combo1) - CL | See Table 24 |
| 343 | VL CEA (P005.103 combo2) -CH1- Fc hole PGLALA | See Table 24 |
| 344 | VH CEA (P005.103 combo2) - CL | See Table 24 |
| 345 | VL CEA (P006.038 combo1) -CH1- Fc hole PGLALA | See Table 24 |
| 346 | VH CEA (P006.038 combo1) - CL | See Table 24 |
| 347 | VL CEA (P006.038 combo2) -CH1- Fc hole PGLALA | See Table 24 |
| 348 | VH CEA (P006.038 combo2) - CL | See Table 24 |
| 349 | VH CD28 (SA_Variant 15) - CH1- Fc knob PGLALA | See Table 24 |
| 350 | VL CD28 (SA_Varaint | See Table 24 |

TABLE B-continued (Sequences):

| SEQ ID NO: | Name | Sequence |
|---|---|---|
| | 15) - CL | |
| 351 | CEA(A5H1EL1D) VL-CH1 hu IgG1 Fc hole PGLALA | EIVLTQSPATLSLSPGERATLSCRASSSVTYIHWYQQKPGQAPRS WIYATSNLASGIPARFSGSGSGTDFTLTISSLEPEDFAVYYCQHW SSKPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| 352 | CEA(A5H1EL1D) VH-Ckappa | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGLRFYFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| 353 | CD28(SA) hu IgG1 VH-CH1 "EE" Fc knob PGLALA | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 354 | CD28(SA) hu IgG1 VL-Ck "RK" | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 355 | CD28(SA_Variant 8) hu IgG1 VH-CH1 "EE" Fc knob PGLALA | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDFNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 356 | CD28(SA_Variant 8) hu IgG1 VL-Ck "RK" | DIQMTQSPSSLSASVGDRVTITCHASQNIYVYLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 357 | CD28(SA_Variant 15) hu IgG1 VH-CH1 "EE" Fc knob PGLALA | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 358 | CD28(SA_Variant 15) hu IgG1 VL-Ck "RK" | DIQMTQSPSSLSASVGDRVTITCHASQNIYVFLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 359 | CD28(SA_Variant 29) hu IgG1 VH-CH1 "EE" Fc knob PGLALA | QVQLVQSGAEVKKPGASVKVSCKASGYTFTSYYIHWVRQAPGQGL EWIGSIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS |

TABLE B-continued (Sequences):

| SEQ ID NO: | Name | Sequence |
|---|---|---|
| | | GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| 360 | CEA(A5H1EL1D) hu IgG1 VH-CH1 "EE" Fc hole PGLALA | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGLRFYFDYWGQGTTVTVSSASTKGPSVFPLAPS SKSTSGGTAALGCLVEDYFPEPVTVSWNSGALTSGVHTFPAVLQS SGLYSLSSVVTVPSSSLGTQTYICNVNHKPSNTKVDEKVEPKSCD KTHTCPPCPAPEAAGGPSVFLFPPKPKDTLMISRTPEVTCVVVDV SHEDPEVKFNWYVDGVEVHNAKTKPREEQYNSTYRVVSVLTVLHQ DWLNGKEYKCKVSNKALGAPIEKTISKAKGQPREPQVCTLPPSRD ELTKNQVSLSCAVKGFYPSDIAVEWESNGQPENNYKTTPPVLDSD GSFFLVSKLTVDKSRWQQGNVFSCSVMHEALHNHYTQKSLSLSP |
| 361 | CEA(A5H1EL1D) hu IgG1 VL-Ck "RK" | EIVLTQSPATLSLSPGERATLSCRASSSVTYIHWYQQKPGQAPRS WIYATSNLASGIPARFSGSGSGTDFTLTISSLEPEDFAVYYCQQW SSKPPTFGQGTKLEIKRTVAAPSVFIFPPSDRKLKSGTASVVCLL NNFYPREAKVQWKVDNALQSGNSQESVTEQDSKDSTYSLSSTLTL SKADYEKHKVYACEVTHQGLSSPVTKSFNRGEC |
| 362 | CD28(SA) VL-CH1 hu IgG1 Fc knob PGLALA | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDKTHTCPPCPAPE AAGGPSVFLFPPKPKDTLMISRTPEVTCVVVDVSHEDPEVKFNWY VDGVEVHNAKTKPREEQYNSTYRVVSVLTVLHQDWLNGKEYKCKV SNKALGAPIEKTISKAKGQPREPQVYTLPPCRDELTKNQVSLWCL VKGFYPSDIAVEWESNGQPENNYKTTPPVLDSDGSFFLYSKLTVD KSRWQQGNVFSCSVMHEALHNHYTQKSLSLSP |
| 363 | CD28(SA) VH-Ckappa | QVQLVQSGAEVKKPGASVKVSCKASGYTFTSYYITHWVRQAPGQGL EWIGCIYPGNVNTNYNEKEKDRATLTVDTSISTAYMELSRLRSDD TAVYFCTRSHYGLDWNFDVWGQGTTVTVSSASVAAPSVFIFPPSD EQLKSGTASVVCLLNNFYPREAKVQWKVDNALQSGNSQESVTEQD SKDSTYSLSSTLTLSKADYEKHKVYACEVTHQGLSSPVTKSFNRG EC |
| 364 | CD28(SA_Variant 8) VL-CH1 hu IgG1 Fc knob PGLALA | DIQMTQSPSSLSASVGDRVTITCHASQNIYVYLNWYQQKPGKAPK LLIYKASNLHTGVPSRFSGSGSGTDFTLTISSLQPEDFATYYCQQ GQTYPYTFGGGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDKTHTCPPCPAPE AAGGPSVFLFPPKPKDTLMISRTPEVTCVVVDVSHEDPEVKFNWY VDGVEVHNAKTKPREEQYNSTYRVVSVLTVLHQDWLNGKEYKCKV SNKALGAPIEKTISKAKGQPREPQVYTLPPCRDELTKNQVSLWCL VKGFYPSDIAVEWESNGQPENNYKTTPPVLDSDGSFFLYSKLTVD KSRWQQGNVFSCSVMHEALHNHYTQKSLSLSP |
| 365 | CD28(SA_Variant 8) VH-Ckappa | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDFNFDVWGQGTTVTVSSASVAAPSVFIFPPSD EQLKSGTASVVCLLNNFYPREAKVQWKVDNALQSGNSQESVTEQD SKDSTYSLSSTLTLSKADYEKHKVYACEVTHQGLSSPVTKSFNRG EC |
| 366 | CD28(SA_Variant 15) VL-CH1 hu IgG1 Fc knob PGLALA | DIQMTQSPSSLSASVGDRVTITCHASQNIYVFLNWYQQKPGKAPK LLIYKASNLHTGVPSRFSGSGSGTDFTLTISSLQPEDFATYYCQQ GQTYPYTFGGGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDKTHTCPPCPAPE AAGGPSVFLFPPKPKDTLMISRTPEVTCVVVDVSHEDPEVKFNWY VDGVEVHNAKTKPREEQYNSTYRVVSVLTVLHQDWLNGKEYKCKV SNKALGAPIEKTISKAKGQPREPQVYTLPPCRDELTKNQVSLWCL VKGFYPSDIAVEWESNGQPENNYKTTPPVLDSDGSFFLYSKLTVD KSRWQQGNVFSCSVMHEALHNHYTQKSLSLSP |
| 367 | CD28(SA_Variant 15) VH-Ckappa | QVQLVQSGAEVKKPGASVKVSCKASGYTFTSYYIHWVRQAPGQGL EWIGSTYPGNVQTNYNEKFKDRATLTVDTSISTAYMELSRLRSDD TAVYFCTRSHYGLDWNFDVWGQGTTVTVSSASVAAPSVFIFPPSD EQLKSGTASVVCLLNNFYPREAKVQWKVDNALQSGNSQESVTEQD |

TABLE B-continued (Sequences):

| SEQ ID NO: | Name | Sequence |
|---|---|---|
| | | SKDSTYSLSSTLTLSKADYEKHKVYACEVTHQGLSSPVTKSFNRGEC |
| 368 | CD28(SA_Variant 29) VH-Ckappa | QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 369 | CEA(T84.66) VL-CH1 hu IgG1 Fc hole PGLALA | EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP |
| 370 | CEA(T84.66) VH-Ckappa | QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 371 | CEA(T84.66) hu IgG1 VH-CH1 "EE" Fc hole PGLALA | QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP |
| 372 | CEA(T84.66) hu IgG1 VL-Ck "RK" | EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC |
| 373 | CEA(A5H1EL1D) VH-CH1-VH-CH1 "EE" hu IgG1 Fc hole PGLALA | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP |
| 374 | CD28(SA) VL-CH1 CEA(A5H1EL1D) VH-CH1 "EE" hu IgG1 Fc knob PGLALA | DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDEL |

TABLE B-continued (Sequences):

| SEQ ID NO: | Name | Sequence |
|---|---|---|
|  |  | TKNQVSLWCLVKGFYPSDIAVEWESNGQPENNYKTTPPVLDSDGS<br>FFLYSKLTVDKSRWQQGNVFSCSVMHEALHNHYTQKSLSLSP |
| 375 | CEA(P002.139) VL-CH1 hu IgG1 Fc hole PGLALA | EIVLTQSPATLSLSPGERATLSCRASSSVTYIHWYQQKPGQAPRS<br>WIYATSNLASGIPARFSGSGSGTDFTLTISSLEPEDFAVYYCQHW<br>SSKPPTFGQGTKLEIKSSASTKGPSVFPLAPSSKSTSGGTAALGC<br>LVKDYFPEPVTVSWNSGALTSGVHTFPAVLQSSGLYSLSSVVTVP<br>SSSLGTQTYICNVNHKPSNTKVDKKVEPKSCDKTHTCPPCPAPEA<br>AGGPSVFLFPPKPKDTLMISRTPEVTCVVVDVSHEDPEVKFNWYV<br>DGVEVHNAKTKPREEQYNSTYRVVSVLTVLHQDWLNGKEYKCKVS<br>NKALGAPIEKTISKAKGQPREPQVCTLPPSRDELTKNQVSLSCAV<br>KGFYPSDIAVEWESNGQPENNYKTTPPVLDSDGSFFLVSKLTVDK<br>SRWQQGNVFSCSVMHEALHNHYTQKSLSLSP |
| 376 | CEA(P002.139) VH-Cka ppa | EVQLLESGGGLVQPGGSLRLSCAASGFTFTDYYMNWVRQAPGKGL<br>EWLGFIGNKANAYTTEYSASVKGRFTISRDKSKNTLYLQMNSLRA<br>EDTATYYCTRDRGLRFYFDYWGQGTTVTVSSASVAAPSVFIFPPS<br>DEQLKSGTASVVCLLNNFYPREAKVQWKVDNALQSGNSQESVTEQ<br>DSKDSTYSLSSTLTLSKADYEKHKVYACEVTHQGLSSPVTKSFNR<br>GEC |
| 377 | CD28 (SA_Variant 8) hu IgG1 light chain | DIQMTQSPSSLSASVGDRVTITCHASQNIYVYLNWYQQKPGKAPK<br>LLIYKASNLHTGVPSRFSGSGSGTDFTLTISSLQPEDFATYYCQQ<br>GQTYPYTFGGGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC |
| 378 | CD28(SA_Variant 8) hu IgG1 PGLALA heavy chain | QVQLVQSGAEVKKPGASVKVSCKASGYTFTSYYIHWVRQAPGQGL<br>EWIGSIYPGNVQTNYNEKFKDRATLTVDTSISTAYMELSRLRSDD<br>TAVYFCTRSHYGLDFNFDVWGQGTTVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVS<br>HEDPEVKFNWYVDGVEVHNAKTKPREEQYNSTYRVVSVLTVLHQD<br>WLNGKEYKCKVSNKALGAPIEKTISKAKGQPREPQVYTLPPSRDE<br>LTKNQVSLTCLVKGFYPSDIAVEWESNGQPENNYKTTPPVLDSDG<br>SFFLYSKLTVDKSRWQQGNVFSCSVMHEALHNHYTQKSLSLSP |
| 379 | CD28 (SA_Variant 11) hu IgG1 light chain | DIQMTQSPSSLSASVGDRVTITCHASQNIYVYLNWYQQKPGKAPK<br>LLIYKASNLHTGVPSRFSGSGSGTDFTLTISSLQPEDFATYYCQQ<br>GQTYPYTFGGGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC |
| 380 | CD28(SA_Variant 11) hu IgG1 PGLALA heavy chain | QVQLVQSGAEVKKPGASVKVSCKASGYTFTSYYIHWVRQAPGQGL<br>EWIGSIYPGNVQTNYNEKFKDRATLTVDTSISTAYMELSRLRSDD<br>TAVYFCTRSHYGLDFNFDVWGQGTTVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVS<br>HEDPEVKFNWYVDGVEVHNAKTKPREEQYNSTYRVVSVLTVLHQD<br>WLNGKEYKCKVSNKALGAPIEKTISKAKGQPREPQVYTLPPSRDE<br>LTKNQVSLTCLVKGFYPSDIAVEWESNGQPENNYKTTPPVLDSDG<br>SFFLYSKLTVDKSRWQQGNVFSCSVMHEALHNHYTQKSLSLSP |
| 381 | CD28 (SA_Variant 15) hu IgG1 light chain | DIQMTQSPSSLSASVGDRVTITCHASQNIYVFLNWYQQKPGKAPK<br>LLIYKASNLHTGVPSRFSGSGSGTDFTLTISSLQPEDFATYYCQQ<br>GQTYPYTFGGGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC |
| 382 | CD28(SA_Variant 15) hu IgG1 PGLALA heavy chain | QVQLVQSGAEVKKPGASVKVSCKASGYTFTSYYIHWVRQAPGQGL<br>EWIGSIYPGNVQTNYNEKFKDRATLTVDTSISTAYMELSRLRSDD<br>TAVYFCTRSHYGLDWNFDVWGQGTTVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVS<br>HEDPEVKFNWYVDGVEVHNAKTKPREEQYNSTYRVVSVLTVLHQD<br>WLNGKEYKCKVSNKALGAPIEKTISKAKGQPREPQVYTLPPSRDE<br>LTKNQVSLTCLVKGFYPSDIAVEWESNGQPENNYKTTPPVLDSDG<br>SFFLYSKLTVDKSRWQQGNVFSCSVMHEALHNHYTQKSLSLSP |
| 383 | CD28 (SA_Variant 27) hu IgG1 light chain | DIQMTQSPSSLSASVGDRVTITCHASQGIYVYLNWYQQKPGKAPK<br>LLIYKASNLHTGVPSRFSGSGSGTDFTLTISSLQPEDFATYYCQQ<br>GQTYPYTFGGGTKVEIKRTVAAPSVFIFPPSDEQLKSGTASVVCL |

TABLE B-continued (Sequences):

| SEQ ID NO: | Name | Sequence |
|---|---|---|
| | | LNNFYPREAKVQWKVDNALQSGNSQESVTEQDSKDSTYSLSSTLT LSKADYEKHKVYACEVTHQGLSSPVTKSFNRGEC |
| 384 | CD28(SA_Variant 27) hu IgG1 PGLALA heavy chain | QVQLVQSGAEVKKPGASVKVSCKASGYTFTSYYIHWVRQAPGQGL EWIGSIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSP |
| 385 | CD28 (SA_Variant 29) hu IgG1 light chain | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 386 | CD28(SA_Variant 29) hu IgG1 PGLALA heavy chain | QVQLVQSGAEVKKPGASVKVSCKASGYTFTSYYIHWVRQAPGQGL EWIGSIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSP |
| 387 | Avi tag | GLNDIFEAQKIEWHE |
| 388 | CD28 VEICH1 "EE"- (G4S)$_2$- FAP(4B9)- VHCH1 "EE" - Fc knob PGLALA | QVQLVQSGAEVKKPGASVKVSCKASGYTFTSYYIHWVRQAPGQGL EWIGCIYPGNVNTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDG GGGSGGGGSEVQLLESGGGLVQPGGSLRLSCAASGFTFSSYAMSW VRQAPGKGLEWVSAIIGSGASTYYADSVKGRFTISRDNSKNTLYL QMNSLRAEDTAVYYCAKGWFGGFNYWGQGTLVTVSSASTKGPSVF PLAPSSKSTSGGTAALGCLVEDYFPEPVTVSWNSGALTSGVHTFP AVLQSSGLYSLSSVVTVPSSSLGTQTYICNVNHKPSNTKVDEKVE PKSCDKTHTCPPCPAPEAAGGPSVFLFPPKPKDTLMISRTPEVTC VVVDVSHEDPEVKFNWYVDGVEVHNAKTKPREEQYNSTYRVVSVL TVLHQDWLNGKEYKCKVSNKALGAPIEKTISKAKGQPREPQVYTL PPCRDELTKNQVSLWCLVKGFYPSDIAVEWESNGQPENNYKTTPP VLDSDGSFFLYSKLTVDKSRWQQGNVFSCSVMHEALHNHYTQKSL SLSP |
| 389 | CD28 VLCL "RK"- (G4S)$_2$- FAP(4B9)- VLCL "RK" | DIQMTQSPSSLSASVGDRVTITCHASQNIYVWLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGECGGGGSGGGGSE IVLTQSPGTLSLSPGERATLSCRASQSVTSSYLAWYQQKPGQAPR LLINVGSRRATGIPDRFSGSGSGTDFTLTISRLEPEDFAVYYCQQ GIMLPPTFGQGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 390 | EpCAM(MT201) hu IgG1 VH-CH1 "EE" Fc hole PGLALA | EVQLLESGGGVVQPGRSLRLSCAASGFTFSSYGMHWVRQAPGKGL EWVAVISYDGSNKYYADSVKGRFTISRDNSKNTLYLQMNSLRAED TAVYYCAKDMGWGSGWRPYYYYGMDVWGQGTTVTVSSASTKGPSV FPLAPSSKSTSGGTAALGCLVEDYFPEPVTVSWNSGALTSGVHTF PAVLQSSGLYSLSSVVTVPSSSLGTQTYICNVNHKPSNTKVDEKV EPKSCDKTHTCPPCPAPEAAGGPSVFLFPPKPKDTLMISRTPEVT CVVVDVSHEDPEVKFNWYVDGVEVHNAKTKPREEQYNSTYRVVSV LTVLHQDWLNGKEYKCKVSNKALGAPIEKTISKAKGQPREPQVCT LPPSRDELTKNQVSLSCAVKGFYPSDIAVEWESNGQPENNYKTTP PVLDSDGSFFLVSKLTVDKSRWQQGNVFSCSVMHEALHNHYTQKS LSLSP |
| 391 | EpCAM(MT201) VL- Ckappa "RK" | ELQMTQSPSSLSASVGDRVTITCRTSQSISSYLNWYQQKPGQPPK LLIYWASTRESGVPDRFSGSGSGTDFTLTISSLQPEDSATYYCQQ |

TABLE B-continued (Sequences):

| SEQ ID NO: | Name | Sequence |
|---|---|---|
| | | SYDIPYTFGQGTKLEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |
| 392 | Her3 VL-CH1 hu IgG1 Fc hole PGLALA | DIVMTQSPDSLAVSLGERATINCKSSQSVLNSGNQKNYLTWYQQK PGQPPKLLIYWASTRESGVPDRFSGSGSGTDFTLTISSLQAEDVA VYYCQSDYSYPYTFGQGTKLEIKSSASTKGPSVFPLAPSSKSTSG GTAALGCLVKDYFPEPVTVSWNSGALTSGVHTFPAVLQSSGLYSL SSVVTVPSSSLGTQTYICNVNHKPSNTKVDKKVEPKSCDKTHTCP PCPAPEAAGGPSVFLFPPKPKDTLMISRTPEVTCVVVDVSHEDPE VKFNWYVDGVEVHNAKTKPREEQYNSTYRVVSVLTVLHQDWLNGK EYKCKVSNKALGAPIEKTISKAKGQPREPQVCTLPPSRDELTKNQ VSLSCAVKGFYPSDIAVEWESNGQPENNYKTTPPVLDSDGSFFLV SKLTVDKSRWQQGNVFSCSVMHEALHNHYTQKSLSLSP |
| 393 | HER3 VH-Ckappa | QVQLVQSGAEVKKPGASVKVSCKASGYTFRSSYISWVRQAPGQGL EWMGWIYAGTGSPSYNQKLQGRVTMTTDTSTSTAYMELRSLRSDD TAVYYCARHRDYYSNSLTYWGQGTLVTVSSASVAAPSVFIFPPSD EQLKSGTASVVCLLNNFYPREAKVQWKVDNALQSGNSQESVTEQD SKDSTYSLSSTLTLSKADYEKHKVYACEVTHQGLSSPVTKSFNRG EC |
| 394 | CD30 VL-CH1 hu IgG1 Fc hole PGLALA | DIVLTQSPASLAVSLGQRATISCKASQSVDFDGDSYMNWYQQKPG QPPKVLIYAASNLESGIPARFSGSGSGTDFTLNIHPVEEEDAATY YCQQSNEDPWTFGGGTKLEIKSSASTKGPSVFPLAPSSKSTSGGT AALGCLVKDYFPEPVTVSWNSGALTSGVHTFPAVLQSSGLYSLSS VVTVPSSSLGTQTYICNVNHKPSNTKVDKKVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGKEY KCKVSNKALGAPIEKTISKAKGQPREPQVCTLPPSRDELTKNQVS LSCAVKGFYPSDIAVEWESNGQPENNYKTTPPVLDSDGSFFLVSK LTVDKSRWQQGNVFSCSVMHEALHNHYTQKSLSLSP |
| 395 | CD30 VH-Ckappa | QTQLQQSGPEVVKPGASVKISCKASGYTFTDYYTTWVKQKPGQGL EWIGWIYPGSGNTKYNEKFKGKATLTVDTSSSTAFMQLSSLTSED TAVYFCANYGNYWFAYWGQGTQVTVSAASVAAPSVFIFPPSDEQL KSGTASVVCLLNNFYPREAKVQWKVDNALQSGNSQESVTEQDSKD STYSLSSTLTLSKADYEKHKVYACEVTHQGLSSPVTKSFNRGEC |
| 396 | TPBG VL-CH1 hu IgG1 Fc hole PGLALA | DIQMTQSPSSLSASVGDRVTITCQASQDISNYLNWYQQKPGKAPK LLIYAASTLQIGVPSRFSGSGSGTDFTFTISSLQPEDFATYYCQQ ANSFPLTFGGGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDKTHTCPPCPAPE AAGGPSVFLFPPKPKDTLMISRTPEVTCVVVDVSHEDPEVKFNWY VDGVEVHNAKTKPREEQYNSTYRVVSVLTVLHQDWLNGKEYKCKV SNKALGAPIEKTISKAKGQPREPQVCTLPPSRDELTKNQVSLSCA VKGFYPSDIAVEWESNGQPENNYKTTPPVLDSDGSFFLVSKLTVD KSRWQQGNVFSCSVMHEALHNHYTQKSLSLSP |
| 397 | TPBG VH-Ckappa | EVHLLESGGGLVHPGGSLRLSCAASGFTFRSDAMHWVRQAPGKGL EWVSGVSGSGGSPYYADSVKGRFTISRDDSKTTLYLQMNSLRAED TAVYYCATGGSIAGSYYYYPMDVWGQGTTVTVSSASVAAPSVFIF PPSDEQLKSGTASVVCLLNNFYPREAKVQWKVDNALQSGNSQESV TEQDSKDSTYSLSSTLTLSKADYEKHKVYACEVTHQGLSSPVTKS FNRGEC |
| 398 | GPRC5D (5E11) hu IgG1 VH-CH1 "EE" Fc hole PGLALA | EVQLLESGGGLVQPGGSLRLSCAASGFTFSKYAMAWVRQAPGKGL EWVASISTGGVNTYYADSVKGRFTISRDNSKNTLYLQMNSLRAED TAVYYCATHTGDYFDYWGQGTMVTVSSASTKGPSVFPLAPSSKST SGGTAALGCLVEDYFPEPVTVSWNSGALTSGVHTFPAVLQSSGLY SLSSVVTVPSSSLGTQTYICNVNHKPSNTKVDEKVEPKSCDKTHT CPPCPAPEAAGGPSVFLFPPKPKDTLMISRTPEVTCVVVDVSHED PEVKFNWYVDGVEVHNAKTKPREEQYNSTYRVVSVLTVLHQDWLN GKEYKCKVSNKALGAPIEKTISKAKGQPREPQVCTLPPSRDELTK NQVSLSCAVKGFYPSDIAVEWESNGQPENNYKTTPPVLDSDGSFF LVSKLTVDKSRWQQGNVFSCSVMHEALHNHYTQKSLSLSP |
| 399 | GPRC5D (5E11)VL-Ckappa "RK" | EIVLTQSPGTLSLSPGERATLSCRASQSVSISGINLMNWYQQKPG QQPKLLIYHASILASGIPDRFSGSGSGTDFTLTISRLEPEDFAVY YCQQTRESPLTFGQGTRLEIKRTVAAPSVFIFPPSDRKLKSGTAS VVCLLNNFYPREAKVQWKVDNALQSGNSQESVTEQDKDSTYSLS STLTLSKADYEKHKVYACEVTHQGLSSPVTKSFNRGEC |
| 400 | CD38 VL-CH1 hu IgG1 | EIVLTQSPATLSLSPGERATLSCRASQSVSSYLAWYQQKPGQAPR |

TABLE B-continued (Sequences):

| SEQ ID NO: | Name | Sequence |
|---|---|---|
|  | Fc hole PGLALA | LLIYDASNRATGIPARFSGSGSGTDFTLTISSLEPEDFAVYYCQQ RSNWPPTFGQGTKVEIKSSASTKGPSVFPLAPSSKSTSGGTAALG CLVKDYFPEPVTVSWNSGALTSGVHTFPAVLQSSGLYSLSSVVTV PSSSLGTQTYICNVNHKPSNTKVDKKVEPKSCDKTHTCPPCPAPE AAGGPSVFLFPPKPKDTLMISRTPEVTCVVVDVSHEDPEVKFNWY VDGVEVHNAKTKPREEQYNSTYRVVSVLTVLHQDWLNGKEYKCKV SNKALGAPIEKTISKAKGQPREPQVCTLPPSRDELTKNQVSLSCA VKGFYPSDIAVEWESNGQPENNYKTTPPVLDSDGSFFLVSKLTVD KSRWQQGNVFSCSVMHEALHNHYTQKSLSLSP |
| 401 | CD38 VH-Ckappa | EVQLLESGGGLVQPGGSLRLSCAVSGFTFNSFAMSWVRQAPGKGL EWVSAISGSGGGTYYADSVKGRFTISRDNSKNTLYLQMNSLRAED TAVYFCAKDKILWFGEPVFDYWGQGTLVTVSSASVAAPSVFIFPP SDEQLKSGTASVVCLLNNFYPREAKVQWKVDNALQSGNSQESVTE QDSKDSTYSLSSTLTLSKADYEKHKVYACEVTHQGLSSPVTKSFN RGEC |
| 402 | BCMA hu IgG1 VH-CH1 "EE" Fc hole PGLALA | EVQLLESGGGLVQPGGSLRLSCAASGFTFSSYAMNWVRQAPGKGL EWVSAITASGGSTYYADSVKGRFTISRDNSKNTLYLQMNSLRAED TAVYYCARYWPMSLWGQGTLVTVSSASTKGPSVFPLAPSSKSTSG GTAALGCLVEDYFPEPVTVSWNSGALTSGVHTFPAVLQSSGLYSL SSVVTVPSSSLGTQTYICNVNHKPSNTKVDEKVEPKSCDKTHTCP PCPAPEAAGGPSVFLFPPKPKDTLMISRTPEVTCVVVDVSHEDPE VKFNWYVDGVEVHNAKTKPREEQYNSTYRVVSVLTVLHQDWLNGK EYKCKVSNKALGAPIEKTISKAKGQPREPQVCTLPPSRDELTKNQ VSLSCAVKGFYPSDIAVEWESNGQPENNYKTTPPVLDSDGSFFLV SKLTVDKSRWQQGNVFSCSVMHEALHNHYTQKSLSLSP |
| 403 | BCMA VL-Ckappa "RK" | EIVLTQSPGTLSLSPGERATLSCRASQSVSAYYLAWYQQKPGQAP RLLMYDASIRATGIPDRFSGSGSGTDFTLTISRLEPEDFAVYYCQ QYERWPLTFGQGTKVEIKRTVAAPSVFIFPPSDRKLKSGTASVVC LLNNFYPREAKVQWKVDNALQSGNSQESVTEQDSKDSTYSLSSTL TLSKADYEKHKVYACEVTHQGLSSPVTKSFNRGEC |
| 404 | GPRC5D (5E11) VH-CH1(EE)-CD3 VL-CH1-Fc (knob, P329GLALA) (GPRC5D TCB) | EVQLLESGGGLVQPGGSLRLSCAASGFTFSKYAMAWVRQAPGKGL EWVASISTGGVNTYYADSVKGRFTISRDNSKNTLYLQMNSLRAED TAVYYCATHTGDYFDYWGQGTMVTVSSASTKGPSVFPLAPSSKST SGGTAALGCLVEDYFPEPVTVSWNSGALTSGVHTFPAVLQSSGLY SLSSVVTVPSSSLGTQTYICNVNHKPSNTKVDEKVEPKSCDGGGG SGGGGSQAVVTQEPSLTVSPGGTVTLTCGSSTGAVTTSNYANWVQ EKPGQAFRGLIGGTNKRAPGTPARFSGSLLGGKAALTLSGAQPED EAEYYCALWYSNLWVFGGGTKLTVLSSASTKGPSVFPLAPSSKST SGGTAALGCLVKDYFPEPVTVSWNSGALTSGVHTFPAVLQSSGLY SLSSVVTVPSSSLGTQTYICNVNHKPSNTKVDKKVEPKSCDKTHT CPPCPAPEAAGGPSVFLFPPKPKDTLMISRTPEVTCVVVDVSHED PEVKFNWYVDGVEVHNAKTKPREEQYNSTYRVVSVLTVLHQDWLN GKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSP |
| 405 | CD3 VH-CL (GPRC5D TCB) | EVQLLESGGGLVQPGGSLRLSCAASGFQFSSYAMNWVRQAPGKGL EWVSRIRSKYNNYATYYADSVKGRFTISRDDSKNTLYLQMNSLRA EDTAVYYCVRHTTPPSSYVSYYGYWGQGTLVTVSSASVAAPSVFI FPPSDEQLKSGTASVVCLLNNFYPREAKVQWKVDNALQSGNSQES VTEQDSKDSTYSLSSTLTLSKADYEKHKVYACEVTHQGLSSPVTK SFNRGEC |
| 406 | CD19 (8B8-2B11) CDR-H1 | DYIMH |
| 407 | CD19 (8B8-2B11) CDR-H2 | YINPYNDGSKYTEKFQG |
| 408 | CD19 (8B8-2B11) CDR-H3 | GTYYYGPQLFDY |
| 409 | CD19 (8B8-2B11) CDR-L1 | KSSQSLETSTGTTYLN |
| 410 | CD19 (8B8-2B11) CDR-L2 | RVSKRFS |
| 411 | CD19 (8B8-2B11) CDR-L3 | LQLLEDPYT |

TABLE B-continued (Sequences):

| SEQ ID NO: | Name | Sequence |
|---|---|---|
| 412 | CD19 (8B8-2B11) VH | QVQLVQSGAEVKKPGASVKVSCKASGYTFTDYIMHWVRQAPGQGL EWMGYINPYNDGSKYTEKFQGRVTMTSDTSISTAYMELSRLRSDD TAVYYCARGTYYYGPQLFDYWGQGTTVTVSS |
| 413 | CD19 (8B8-2B11) VL | DIVMTQTPLSLSVTPGQPASISCKSSQSLETSTGTTYLNWYLQKP GQSPQLLIYRVSKRFSGVPDRFSGSGSGTDFTLKISRVEAEDVGV YYCLQLLEDPYTFGQGTKLEIK |
| 414 | CD19 (8B8-018) CDR-H1 | DYIMH |
| 415 | CD19 (8B8-018) CDR-H2 | YINPYNDGSKYTEKFQG |
| 416 | CD19 (8B8-018) CDR-H3 | GTYYYGSALFDY |
| 417 | CD19 (8B8-018) CDR-L1 | KSSQSLENPNGNTYLN |
| 418 | CD19 (8B8-018) CDR-L2 | RVSKRFS |
| 419 | CD19 (8B8-018) CDR-L3 | LQLTHVPYT |
| 420 | CD19 (8B8-018) VH | QVQLVQSGAEVKKPGASVKVSCKASGYTFTDYIMHWVRQAPGQGL EWMGYINPYNDGSKYTEKFQGRVTMTSDTSISTAYMELSRLRSDD TAVYYCARGTYYYGSALFDYWGQGTTVTVSS |
| 421 | CD19 (8B8-018) VL | DIVMTQTPLSLSVTPGQPASISCKSSQSLENPNGNTYLNWYLQKP GQSPQLLIYRVSKRFSGVPDRFSGSGSGTDFTLKISRVEAEDVGV YYCLQLTHVPYTFGQGTKLEIK |
| 422 | CD79b (huMA79b.v28) CDR-H1 | SYWIE |
| 423 | CD79b (huMA79b.v28) CDR-H2 | EILPGGGDTNYNEIFKG |
| 424 | CD79b (huMA79b.v28) CDR-H3 | RVPIRLDY |
| 425 | CD79b (huMA79b.v28) CDR-L1 | KASQSVDYEGDSFLN |
| 426 | CD79b (huMA79b.v28) CDR-L2 | AASNLES |
| 427 | CD79b (huMA79b.v28) CDR-L3 | QQSNEDPLT |
| 428 | CD79b (huMA79b.v28) VH | EVQLVESGGGLVQPGGSLRLSCAASGYTFSSYWIEWVRQAPGKGL EWIGEILPGGGDTNYNEIFKGRATFSADTSKNTAYLQMNSLRAED TAVYYCTRRVPIRLDYWGQGTLVTVSS |
| 429 | CD79b (huMA79b.v28) VL | DIQLTQSPSSLSASVGDRVTITCKASQSVDYEGDSFLNWYQQKPG KAPKLLIYAASNLESGVPSRFSGSGSGTDFTLTISSLQPEDFATY YCQQSNEDPLTFGQGTKVEIK |
| 430 | VL (CD19 2B11) -CH1 Fc hole PGLALA | DIVMTQTPLSLSVTPGQPASISCKSSQSLETSTGTTYLNWYLQKP GQSPQLLIYRVSKRFSGVPDRFSGSGSGTDFTLKISRVEAEDVGV YYCLQLLEDPYTFGQGTKLEIKSSASTKGPSVFPLAPSSKSTSGG TAALGCLVKDYFPEPVTVSWNSGALTSGVHTFPAVLQSSGLYSLS SVVTVPSSSLGTQTYICNVNHKPSNTKVDKKVEPKSCDKTHTCPP CPAPEAAGGPSVFLFPPKPKDTLMISRTPEVTCVVVDVSHEDPEV KFNWYVDGVEVHNAKTKPREEQYNSTYRVVSVLTVLHQDWLNGKE YKCKVSNKALGAPIEKTISKAKGQPREPQVCTLPPSRDELTKNQV SLSCAVKGFYPSDIAVEWESNGQPENNYKTTPPVLDSDGSFFLVS KLTVDKSRWQQGNVFSCSVMHEALHNHYTQKSLSLSP |
| 431 | VH (CD19 2B11) CL | QVQLVQSGAEVKKPGASVKVSCKASGYTFTDYIMHWVRQAPGQGL EWMGYINPYNDGSKYTEKFQGRVTMTSDTSISTAYMELSRLRSDD TAVYYCARGTYYYGPQLFDYWGQGTTVTVSSASVAAPSVFIFPPS DEQLKSGTASVVCLLNNFYPREAKVQWKVDNALQSGNSQESVTEQ |

TABLE B-continued (Sequences):

| SEQ ID NO: | Name | Sequence |
|---|---|---|
| | | DSKDSTYSLSSTLTLSKADYEKHKVYACEVTHQGLSSPVTKSFNR GEC |
| 432 | VL (huMA79b.v28) - CH1 Fc hole PGLALA | DIQLTQSPSSLSASVGDRVTITCKASQSVDYEGDSFLNWYQQKPG KAPKLLIYAASNLESGVPSRFSGSGSGTDFTLTISSLQPEDFATY YCQQSNEDPLTFGQGTKVEIKSSASTKGPSVFPLAPSSKSTSGGT AALGCLVKDYFPEPVTVSWNSGALTSGVHTFPAVLQSSGLYSLSS VVTVPSSSLGTQTYICNVNHKPSNTKVDKKVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGKEY KCKVSNKALGAPIEKTISKAKGQPREPQVCTLPPSRDELTKNQVS LSCAVKGFYPSDIAVEWESNGQPENNYKTTPPVLDSDGSFFLVSK LTVDKSRWQQGNVFSCSVMHEALHNHYTQKSLSLSP |
| 433 | VH (huMA79b.v28) CL | EVQLVESGGGLVQPGGSLRLSCAASGYTFSSYWIEWVRQAPGKGL EWIGEILPGGGDTNYNEIFKGRATFSADTSKNTAYLQMNSLRAED TAVYYCTRRVPIRLDYWGQGTLVTVSSASVAAPSVFIFPPSDEQL KSGTASVVCLLNNFYPREAKVQWKVDNALQSGNSQESVTEQDSKD STYSLSSTLTLSKADYEKHKVYACEVTHQGLSSPVTKSFNRGEC |
| 434 | Human CD19 | UniProt accession No. P15391 |
| 435 | Human CD79b | UniProt accession No. P40259 |
| 436 | Human CD20 | UniProt accession No. P11836 |
| 437 | Human CD22 | UniProt accession No. P20273 |
| 438 | Human CD37 | uniprot accession no. P11049 |
| 439 | CD3-HCDR1 | TYAMN |
| 440 | CD3-HCDR2 | RIRSKYNNYATYYADSVKG |
| 441 | CD3-HCDR3 | HGNFGNSYVSWFAY |
| 442 | CD3-LCDR1 | GSSTGAVTTSNYAN |
| 443 | CD3-LCDR2 | GTNKRAP |
| 444 | CD3-LCDR3 | ALWYSNLWV |
| 445 | CD3 VH | EVQLLESGGGLVQPGGSLRLSCAASGFTFSTYAMNWVRQAPGKGL EWVSRIRSKYNNYATYYADSVKGRFTISRDDSKNTLYLQMNSLRA EDTAVYYCVRHGNFGNSYVSWFAYWGQGTLVTVSS |
| 446 | CD3 VL | QAVVTQEPSLTVSPGGTVTLTCGSSTGAVTTSNYANWVQEKPGQA FRGLIGGTNKRAPGTPARFSGSLLGGKAALTLSGAQPEDEAEYYC ALWYSNLWVFGGGTKLTVL |
| 447 | CD20-HCDR1 | YSWIN |
| 448 | CD20-HCDR2 | RIFPGDGDTDYNGKFK |
| 449 | CD20-HCDR3 | NVFDGYWLVY |
| 450 | CD20-LCDR1 | RSSKSLLHSNGITYLY |
| 451 | CD20-LCDR2 | QMSNLVS |
| 452 | CD20-LCDR3 | AQNLELPYT |
| 453 | CD20 VH | QVQLVQSGAEVKKPGSSVKVSCKASGYAFSYSWINWVRQAPGQGL EWMGRIFPGDGDTDYNGKFKGRVTITADKSTSTAYMELSSLRSED TAVYYCARNVFDGYWLVYWGQGTLVTVSS |
| 454 | CD20 VL | DIVMTQTPLSLPVTPGEPASISCRSSKSLLHSNGITYLYWYLQKP GQSPQLLIYQMSNLVSGVPDRFSGSGSGTDFTLKISRVEAEDVGV YYCAQNLELPYTFGGGTKVEIK |
| 455 | CD20 VH-CH1(EE)- CD3 VL-CH1-Fc (knob P329G LALA) | QVQLVQSGAEVKKPGSSVKVSCKASGYAFSYSWINWVRQAPGQGL EWMGRIFPGDGDTDYNGKFKGRVTITADKSTSTAYMELSSLRSED TAVYYCARNVFDGYWLVYWGQGTLVTVSSASTKGPSVFPLAPSSK STSGGTAALGCLVEDYFPEPVTVSWNSGALTSGVHTFPAVLQSSG LYSLSSVVTVPSSSLGTQTYICNVNHKPSNTKVDEKVEPKSCDGG |

TABLE B-continued (Sequences):

| SEQ ID NO: | Name | Sequence |
|---|---|---|
| | | GGSGGGGSQAVVTQEPSLTVSPGGTVTLTCGSSTGAVTTSNYANW VQEKPGQAFRGLIGGTNKRAPGTPARFSGSLLGGKAALTLSGAQP EDEAEYYCALWYSNLWVFGGGTKLTVLSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKKVEPKSCDKT HTCPPCPAPEAAGGPSVFLFPPKPKDTLMISRTPEVTCVVVDVSH EDPEVKFNWYVDGVEVHNAKTKPREEQYNSTYRVVSVLTVLHQDW LNGKEYKCKVSNKALGAPIEKTISKAKGQPREPQVYTLPPCRDEL TKNQVSLWCLVKGFYPSDIAVEWESNGQPENNYKTTPPVLDSDGS FFLYSKLTVDKSRWQQGNVFSCSVMHEALHNHYTQKSLSLSP |
| 456 | CD20 VH-CH1(EE)-Fc (hole, P329G LALA) | QVQLVQSGAEVKKPGSSVKVSCKASGYAFSYSWINWVRQAPGQGL EWMGRIFPGDGDTDYNGKFKGRVTITADKSTSTAYMELSSLRSED TAVYYCARNVFDGYWLVYWGQGTLVTVSSASTKGPSVFPLAPSSK STSGGTAALGCLVEDYFPEPVTVSWNSGALTSGVHTFPAVLQSSG LYSLSSVVTVPSSSLGTQTYICNVNHKPSNTKVDEKVEPKSCDKT HTCPPCPAPEAAGGPSVFLFPPKPKDTLMISRTPEVTCVVVDVSH EDPEVKFNWYVDGVEVHNAKTKPREEQYNSTYRVVSVLTVLHQDW LNGKEYKCKVSNKALGAPIEKTISKAKGQPREPQVCTLPPSRDEL TKNQVSLSCAVKGFYPSDIAVEWESNGQPENNYKTTPPVLDSDGS FFLVSKLTVDKSRWQQGNVFSCSVMHEALHNHYTQKSLSLSP |
| 457 | CD20 VL-CL(RK) | DIVMTQTPLSLPVTPGEPASISCRSSKSLLHSNGITYLYWYLQKP GQSPQLLIYQMSNLVSGVPDRFSGSGSGTDFTLKISRVEAEDVGV YYCAQNLELPYTFGGGTKVEIKRTVAAPSVFIFPPSDRKLKSGTA SVVCLLNNFYPREAKVQWKVDNALQSGNSQESVTEQDSKDSTYSL SSTLTLSKADYEKHKVYACEVTHQGLSSPVTKSFNRGEC |
| 458 | CD3 VH-CL | EVQLLESGGGLVQPGGSLRLSCAASGFTFSTYAMNWVRQAPGKGL EWVSRIRSKYNNYATYYADSVKGRFTISRDDSKNTLYLQMNSLRA EDTAVYYCVRHGNFGNSYVSWFAYWGQGTLVTVSSASVAAPSVFI FPPSDEQLKSGTASVVCLLNNFYPREAKVQWKVDNALQSGNSQES VTEQDSKDSTYSLSSTLTLSKADYEKHKVYACEVTHQGLSSPVTK SFNRGEC |
| 459 | Human PD-L1 | Uniprot accession no. Q9NZQ7 |
| 460 | VH (PD-L1) | EVQLVESGGGLVQPGGSLRLSCAASGFTFSDSWIHWVRQAPGKGL EWVAWISPYGGSTYYADSVKGRFTISADTSKNTAYLQMNSLRAED TAVYYCARRHWPGGFDYWGQGTLVTVSS |
| 461 | VL (PD-L1) | DIQMTQSPSSLSASVGDRVTITCRASQDVSTAVAWYQQKPGKAPK LLIYSASFLYSGVPSRFSGSGSGTDFTLTISSLQPEDFATYYCQQ YLYHPATFGQGTKVEIK |
| 462 | VH (PD-L1) | EVQLVESGGGLVQPGGSLRLSCAASGFTFSRYWMSWVRQAPGKGL EWVANIKQDGSEKYYVDSVKGRFTISRDNAKNSLYLQMNSLRAED TAVYYCAREGGWFGELAFDYWGQGTLVTVSS |
| 463 | VL (PD-L1) | EIVLTQSPGTLSLSPGERATLSCRASQRVSSSYLAWYQQKPGQAP RLLIYDASSRATGIPDRFSGSGSGTDFTLTISRLEPEDFAVYYCQ QYGSLPWTFGQGTKVEIK |
| 464 | human PD-1 | Uniprot Q15116 |
| 465 | VH (PD-1) | QVQLVQSGVEVKKPGASVKVSCKASGYTFTNYYMYWVRQAPGQGL EWMGGINPSNGGTNFNEKFKNRVTLTTDSSTTTAYMELKSLQFDD TAVYYCARRDYRFDMGFDYWGQGTTVTVSS |
| 466 | VL (PD-1) | EIVLTQSPATLSLSPGERATLSCRASKGVSTSGYSYLHWYQQKPG QAPRLLIYLASYLESGVPARFSGSGSGTDFTLTISSLEPEDFAVY YCQHSRDLPLTFGGGTKVEIK |
| 467 | VH (PD-1) | QVQLVESGGGVVQPGRSLRLDCKASGITFSNSGMHWVRQAPGKGL EWVAVIWYDGSKRYYADSVKGRFTISRDNSKNTLFLQMNSLRAED TAVYYCATNDDYWGQGTLVTVSS |
| 468 | VL (PD-1) | EIVLTQSPATLSLSPGERATLSCRASQSVSSYLAWYQQKPGQAPR LLIYDASNRATGIPARFSGSGSGTDFTLTISSLEPEDFAVYYCQQ SSNWPRTFGQGTKVEIK |
| 469 | human EpCAM | UniProt no. P16422 |
| 470 | murine EpCAM | UniProt no. Q99JW5 |

TABLE B-continued (Sequences):

| SEQ ID NO: | Name | Sequence |
|---|---|---|
| 471 | human HER3 | UniProt no. P21860 |
| 472 | human CD30 | UniProt no. P28908 |
| 473 | human TBPG | UniProt no. Q13641 |
| 474 | human CD38 | UniProt no. P28907 |
| 475 | human BCMA | UniProt no. Q02223 |
| 476 | human GPRC5D | UniProt no. Q9NZD1 |
| 477 | IgGCH1 domain | ASTKGPSVFPLAPSSKSTSGGTAALGCLVKDYFPEPVTVSWNSGA LTSGVHTFPAVLQSSGLYSLSSVVTVPSSSLGTQTYICNVNHKPS NTKVDKKV |
| 478 | IgGCH2 domain | APELLGGPSVFLFPPKPKDTLMISRTPEVTCVWDVSHEDPEVKFN WYVDGVEVHNAKTKPREEQESTYRWSVLTVLHQDWLNGKEYKCKV SNKALPAPIEKTISKAK |
| 479 | IgGCH3 domain | GQPREPQVYTLPPSRDELTKNQVSLTCLVKGFYPSDIAVEWESNG QPENNYKTTPPVLDSDGSFFLYSKLTVDKSRWQQGNVFSCSVMHE ALHNHYTQKSLSLSPG |
| 480 | CH1 connector | EPKSC |
| 481 | Hinge full | DKTHTCPXCP with X being S or P |
| 482 | Hinge middle | HTCPXCP with X being S or P |
| 483 | Hinge short | CPXCP with X being S or P |
| 484 | IgG1, caucasian allotype | ASTKGPSVFPLAPSSKSTSGGTAALGCLVKDYFPEPVTVSWNSGA LTSGVHTFPAVLQSSGLYSLSSVVTVPSSSLGTQTYICNVNHKPS NTKVDKKVEPKSCDKTHTCPPCPAPELLGGPSVFLFPPKPKDTLM ISRTPEVTCVVVDVSHEDPEVKFNWYVDGVEVHNAKTKPREEQYN STYRVVSVLTVLHQDWLNGKEYKCKVSNKALPAPIEKTISKAKGQ PREPQVYTLPPSRDELTKNQVSLTCLVKGFYPSDIAVEWESNGQP ENNYKTTPPVLDSDGSFFLYSKLTVDKSRWQQGNVFSCSVMHEAL HNHYTQKSLSLSPGK |
| 485 | IgG1, afroamerican allotype | ASTKGPSVFPLAPSSKSTSGGTAALGCLVKDYFPEPVTVSWNSGA LTSGVHTFPAVLQSSGLYSLSSVVTVPSSSLGTQTYICNVNHKPS NTKVDKKVEPKSCDKTHTCPPCPAPELLGGPSVFLFPPKPKDTLM ISRTPEVTCVVVDVSHEDPEVKFNWYVDGVEVHNAKTKPREEQYN STYRVVSVLTVLHQDWLNGKEYKCKVSNKALPAPIEKTISKAKGQ PREPQVYTLPPSREEMTKNQVSLTCLVKGFYPSDIAVEWESNGQP ENNYKTTPPVLDSDGSFFLYSKLTVDKSRWQQGNVFSCSVMHEAL HNHYTQKSLSLSPGK |
| 486 | IgG2 | ASTKGPSVFPLAPCSRSTSESTAALGCLVKDYFPEPVTVSWNSGA LTSGVHTFPAVLQSSGLYSLSSVVTVPSSNFGTQTYTCNVDHKPS NTKVDKTVERKCCVECPPCPAPPVAGPSVFLFPPKPKDTLMISRT PEVTCVVVDVSHEDPEVQFNWYVDGVEVHNAKTKPREEQFNSTFR VVSVLTVVHQDWLNGKEYKCKVSNKGLPAPIEKTISKTKGQPREP QVYTLPPSREEMTKNQVSLTCLVKGFYPSDISVEWESNGQPENNY KTTPPMLDSDGSFFLYSKLTVDKSRWQQGNVFSCSVMHEALHNHY TQKSLSLSPGK |
| 487 | IgG3 | ASTKGPSVFPLAPCSRSTSGGTAALGCLVKDYFPEPVTVSWNSGA LTSGVHTFPAVLQSSGLYSLSSVVTVPSSSLGTQTYTCNVNHKPS NTKVDKRVELKTPLGDTTHTCPRCPEPKSCDTPPPCPRCPEPKSC DTPPPCPRCPEPKSCDTPPPCPRCPAPELLGGPSVFLFPPKPKDT LMISRTPEVTCVVVDVSHEDPEVQFKWYVDGVEVHNAKTKPREEQ YNSTFRVVSVLTVLHQDWLNGKEYKCKVSNKALPAPIEKTISKTK GQPREPQVYTLPPSREEMTKNQVSLTCLVKGFYPSDIAVEWESSG QPENNYNTTPPMLDSDGSFFLYSKLTVDKSRWQQGNIFSCSVMHE ALHNRFTQKSLSLSPGK |
| 488 | IgG4 | ASTKGPSVFPLAPCSRSTSESTAALGCLVKDYFPEPVTVSWNSGA LTSGVHTFPAVLQSSGLYSLSSVVTVPSSSLGTKTYTCNVDHKPS NTKVDKRVESKYGPPCPSCPAPEFLGGPSVFLFPPKPKDTLMISR TPEVTCVVVDVSQEDPEVQFNWYVDGVEVHNAKTKPREEQFNSTY RVVSVLTVLHQDWLNGKEYKCKVSNKGLPSSIEKTISKAKGQPRE PQVYTLPPSQEEMTKNQVSLTCLVKGFYPSDIAVEWESNGQPENN |

TABLE B-continued (Sequences):

| SEQ ID NO: | Name | Sequence |
|---|---|---|
| | | YKTTPPVLDSDGSFFLYSRLTVDKSRWQEGNVFSCSVMHEALHNH YTQKSLSLSLGK |
| 489 | CD28(variant 8) CDR-H1 | SYYIH |
| 490 | CD28(variant 8) CDR-H2 | SIYPGNVQTNYNEKFKD |
| 491 | CD28(variant 8) CDR-H3 | SHYGLDWNFDV |
| 492 | CD28(variant 8) CDR-L1 | HASQNIYVYLN |
| 493 | CD28(variant 8) CDR-L2 | KASNLHT |
| 494 | CD28(variant 8) CDR-L3 | QQGQTYPYT |
| 495 | CD28(variant 15) CDR-H1 | SYYIH |
| 496 | CD28(variant 15) CDR-H2 | SIYPGNVQTNYNEKFKD |
| 497 | CD28(variant 15) CDR-H3 | SHYGLDWNFDV |
| 498 | CD28(variant 15) CDR-L1 | HASQNIYVFLN |
| 499 | CD28(variant 15) CDR-L2 | KASNLHT |
| 500 | CD28(variant 15) CDR-L3 | QQGQTYPYT |
| 501 | CD28(variant 29) CDR-H1 | SYYIH |
| 502 | CD28(variant 29) CDR-H2 | SIYPGNVNTNYNEKFKD |
| 503 | CD28(variant 29) CDR-H3 | SHYGLDWNFDV |
| 504 | CD28(variant 29) CDR-L1 | HASQNIYVWLN |
| 505 | CD28(variant 29) CDR-L2 | KASNLHT |
| 506 | CD28(variant 29) CDR-L3 | QQGQTYPYT |
| 507 | CEA (T84.66-LCHA)-CDR-H1 | DTYMH |
| 508 | CEA (T84.66-LCHA)-CDR-H2 | RIDPANGNSKYVPKFQG |
| 509 | CEA (T84.66-LCHA)-CDR-H3 | FGYYVSDYAMAY |
| 510 | CEA (T84.66-LCHA)-CDR-L1 | RAGESVDIFGVGFLH |
| 511 | CEA (T84.66-LCHA)-CDR-L2 | RASNRAT |
| 512 | CEA (T84.66-LCHA)-CDR-L3 | QQTNEDPYT |

TABLE B-continued (Sequences):

| SEQ ID NO: | Name | Sequence |
|---|---|---|
| 513 | CEA (T84.66-LCHA) VH | QVQLVQSGAEVKKPGSSVKVSCKASGFNIKDTYMHWVRQAPGQGL EWMGRIDPANGNSKYVPKFQGRVTITADTSTSTAYMELSSLRSED TAVYYCAPFGYYVSDYAMAYWGQGTLVTVSS |
| 514 | CEA (T84.66-LCHA) VL | EIVLTQSPATLSLSPGERATLSCRAGESVDIFGVGFLHWYQQKPG QAPRLLIYRASNRATGIPARFSGSGSGTDFTLTISSLEPEDFAVY YCQQTNEDPYTFGQGTKLEIK |
| 515 | EpCAM (MT201)- CDR-H1 | SYGMH |
| 516 | EpCAM (MT201)- CDR-H2 | VISYDGSNKYYADSVKG |
| 517 | EpCAM (MT201)- CDR-H3 | DMGWGSGWRPYYYYGM |
| 518 | EpCAM (MT201)- CDR-L1 | RTSQSISSYLN |
| 519 | EpCAM (MT201)- CDR-L2 | WASTRES |
| 520 | EpCAM (MT201)- CDR-L3 | QQSYDIPYT |
| 521 | EpCAM (MT201) VH | EVQLLESGGGVVQPGRSLRLSCAASGFTFSSYGMHWVRQAPGK GLEWVAVISYDGSNKYYADSVKGRFTISRDNSKNTLYLQMNSL RAEDTAVYYCAKDMGWGSGWRPYYYYGMDVWGQGTTVTVSS |
| 522 | EpCAM (MT201) VL | ELQMTQSPSSLSASVGDRVTITCRTSQSISSYLNWYQQKPGQPPK LLIYWASTRESGVPDRFSGSGSGTDFTLTISSLQPEDSATYYCQQ SYDIPYTFGQGTKLEIK |
| 523 | HER3-CDR-H1 | SSYIS |
| 524 | HER3-CDR-H2 | WIYAGTGSPSYNQKLQG |
| 525 | HER3-CDR-H3 | HRDYYSNSL |
| 526 | HER3-CDR-L1 | KSSQSVLNSGNQKNYLT |
| 527 | HER3-CDR-L2 | WASTRES |
| 528 | HER3-CDR-L3 | QSDYSYPYT |
| 529 | HER3 VH | QVQLVQSGAEVKKPGASVKVSCKASGYTFRSSYISWVRQAPGQGL EWMGWIYAGTGSPSYNQKLQGRVTMTTDTSTSTAYMELRSLRSDD TAVYYCARHRDYYSNSLTWGQGTLVTVSS |
| 530 | HER3 VL | DIVMTQSPDSLAVSLGERATINCKSSQSVLNSGNQKNYLTWYQQK PGQPPKLLIYWASTRESGVPDRFSGSGSGTDFTLTISSLQAEDVA VYYCQSDYSYPYTFGQGTKLEIK |
| 531 | CD30- CDR-H1 | DYYIT |
| 532 | CD30- CDR-H2 | WIYPGSGNTKYNEKFKG |
| 533 | CD30- CDR-H3 | YGNYWF |
| 534 | CD30- CDR-L1 | KASQSVDFDGDSYMN |
| 535 | CD30- CDR-L2 | AASNLES |
| 536 | CD30- CDR-L3 | QQSNEDPWT |
| 537 | CD30 VH | QIQLQQSGPEVVKPGASVKISCKASGYTFTDYYITWVKQKPGQGL EWIGWIYPGSGNTKYNEKFKGKATLTVDTSSSTAFMQLSSLTSED TAVYFCANYGNYWFAYWGQGTQVTVSA |
| 538 | CD30 VL | DIVLTQSPASLAVSLGQRATISCKASQSVDFDGDSYMNWYQQKPG QPPKVLIYAASNLESGIPARFSGSGSGTDFTLNIHPVEEEDAATY YCQQSNEDPWTFGGGTKLEIK |
| 539 | TPBG(FAB091)- CDR- | SDAMH |

TABLE B-continued (Sequences):

| SEQ ID NO: | Name | Sequence |
|---|---|---|
| | H1 | |
| 540 | TPBG(FAB091)-CDR-H2 | GVSGSGGSPYYADSVKG |
| 541 | TPBG(FAB091)-CDR-H3 | GGSIAGSYYYYPMDV |
| 542 | TPBG(FAB091)-CDR-L1 | QASQDISNYLN |
| 543 | TPBG(FAB091)-CDR-L2 | AASTLQI |
| 544 | TPBG(FAB091)-CDR-L3 | QQANSFPLT |
| 545 | TPBG(FAB091) VH | EVHLLESGGGLVHPGGSLRLSCAASGFTFRSDAMHWVRQAPGKGLEWVSGVSGSGGSPYYADSVKGRFTISRDDSKTTLYLQMNSLRAEDTAVYYCATGGSTAGSYYYYPMDVWGQGTTVTVSS |
| 546 | TPBG(FAB091) VL | DIQMTQSPSSLSASVGDRVTITCQASQDISNYLNWYQQKPGKAPKLLIYAASTLQIGVPSRFSGSGSGTDFTFTISSLQPEDFATYYCQQANSFPLTFGGGTKVEIK |
| 547 | CD38-CDR-H1 | SFAMS |
| 548 | CD38-CDR-H2 | AISGSGGGTYYADSVKG |
| 549 | CD38-CDR-H3 | DKILWFGEPVFDY |
| 550 | CD38-CDR-L1 | RASQSVSSYLA |
| 551 | CD38-CDR-L2 | DASNRAT |
| 552 | CD38-CDR-L3 | QQRSNWPPT |
| 553 | CD38 VH | EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSS |
| 554 | CD38 VL | EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIK |
| 555 | BCMA - CDR-H1 | SYAMN |
| 556 | BCMA - CDR-H2 | AITASGGSTYYADSVKG |
| 557 | BCMA - CDR-H3 | YWPMSL |
| 558 | BCMA - CDR-L1 | RASQSVSAYYLA |
| 559 | BCMA - CDR-L2 | DASIRAT |
| 560 | BCMA - CDR-L3 | QQYERWPLT |
| 561 | BCMA VH | EVQLLESGGGLVQPGGSLRLSCAASGFTFSSYAMNWVRQAPGKGLEWVSAITASGGSTYYADSVKGRFTISRDNSKNTLYLQMNSLRAEDTAVYYCARYWPMSLWGQGTLVTVSS |
| 562 | BCMA VL | EIVLTQSPGTLSLSPGERATLSCRASQSVSAYYLAWYQQKPGQAPRLLMYDASIRATGIPDRFSGSGSGTDFTLTISRLEPEDFAVYYCQQYERWPLTFGQGTKVEIK |
| 563 | GPRC5D (5E11) - CDR-H1 | KYAMA |
| 564 | GPRC5D (5E11) - CDR-H2 | SISTGGVNTYYADSVKG |
| 565 | GPRC5D (5E11) - CDR-H3 | HTGDYFDY |
| 566 | GPRC5D (5E11) - | RASQSVSISGINLMN |

TABLE B-continued (Sequences):

| SEQ ID NO: | Name | Sequence |
|---|---|---|
| 567 | GPRC5D (5E11) - CDR-L1 | HASILAS |
| 568 | GPRC5D (5E11) - CDR-L2 | QQTRESPLT |
| 569 | GPRC5D (5E11) VH1c | EVQLLESGGGLVQPGGSLRLSCAASGFTFSKYAMAWVRQAPGKGL EWVASISTGGVNTYYADSVKGRFTISRDNSKNTLYLQMNSLRAED TAVYYCATHTGDYFDYWGQGTMVTVSS |
| 570 | GPRC5D (5E11) VL2b | EIVLTQSPGTLSLSPGERATLSCRASQSVSISGINLMNWYQQKPG QQPKLLIYHASILASGIPDRFSGSGSGTDFTLTISRLEPEDFAVY YCQQTRESPLTFGQGTRLEIK |
| 571 | GPRC5D (5E11) VH1a | EVQLLESGGGLVQPGGSLRLSCAASGFTFSKYAMAWVRQAPGKGL EWVASISTGGVNTYYRDSVKARFTISRDNSKNTLYLQMNSLRAED TAVYYCATHTGDYFDYWGQGTMVTVSS |
| 572 | GPRC5D (5E11) VH1b | ELQLLESGGGLVQPGGSLRLSCAASGFTFSKYAMAWVRQAPGKGL EWVASISTGGVNTYYRDSVKARFTISRDNAKNTLYLQMNSLRAED TAVYYCATHTGDYFDYWGQGTMVTVSS |
| 573 | GPRC5D (5E11) VH1d | ELQLLESGGGLVQPGGSLRLSCAASGFTFSKYAMAWVRQAPGKGL EWVASISTGGVNTYYADSVKGRFTISRDNAKNTLYLQMNSLRAED TAVYYCATHTGDYFDYWGQGTMVTVSS |
| 574 | GPRC5D (5E11) VL1a | DIVMTQSPDSLAVSLGERATINCRASQSVSISGINLMNWYQQKPG QQPKLLIYHASILASGVPDRFSGSGSGTDFTLTISSLQAEDVAVY YCQQTRESPLTFGQGTRLEIK |
| 575 | GPRC5D (5E11) VL1c | DIVMTQSPDSLAVSLGERATINCKSSQSVSISGINLMNWYQQKPG QQPKLLIYHASILASGVPDRFSGSGSGTDFTLTISSLQAEDVAVY YCQQTRESPLTFGQGTRLEIK |
| 576 | GPRC5D (5E11) VL2a | EIVLTQSPGTLSLSPGERATLSCRASQSVSISGINLMNWYQQKPG QQPRLLIYHASILASGIPDRFSGSGSGTDFTLTISRLEPEDFAVY YCQQTRESPLTFGQGTRLEIK |
| 577 | GPRC5D (5E11) VL3a | DIQMTQSPSSLSASVGDRVTITCRASQSVSISGINLMNWYQQKPG KQPKLLIYHASILASGVPSRFSGSGSGTDFTLTISSLQPEDFATY YCQQTRESPLTFGQGTRLEIK |
| 578 | GPRC5D (5E11) VL3b | DIQMTQSPSSLSASVGDRVTITCRASQSVSISGINLMNWYQQKPG QQPKLLIYHASILASGVPSRFSGSGSGTDFTLTISSLQPEDFATY YCQQTRESPLTFGQGTRLEIK |
| 579 | GPRC5D (5F11) - CDR-H1 | NYGMA |
| 580 | GPRC5D (5F11) - CDR-H2 | SISTGGGNTYYRDSVKG |
| 581 | GPRC5D (5F11) - CDR-H3 | HDRGGLY |
| 582 | GPRC5D (5F11) - CDR-L1 | RSSKSLLHSNGITYVY |
| 583 | GPRC5D (5F11) - CDR-L2 | RMSNRAS |
| 584 | GPRC5D (5F11) - CDR-L3 | GQLLENPYT |
| 585 | GPRC5D (5F11) VH1a | QVQLVESGGGVVQPGRSLRLSCAASGFSFSNYGMAWVRQAPGKGL EWVASISTGGGNTYYRDSVKGRFTISRDNSKNTLYLQMNSLRAED TAVYYCTRHDRGGLYWGQGTMVTVSS |
| 586 | GPRC5D (5F11) VH1b | EVQLVESGGGVVQPGRSLRLSCAASGFSFSNYGMAWVRQAPGKGL EWVASISTGGGNTYYRDSVKGRFTISRDNAKNTLYLQMNSLRAED TAVYYCTRHDRGGLYWGQGTMVTVSS |
| 587 | GPRC5D (5F11) VH1c | QVQLVESGGGVVQPGRSLRLSCAASGFSFSNYGMAWVRQAPGKGL |

TABLE B-continued (Sequences):

| SEQ ID NO: | Name | Sequence |
|---|---|---|
| | | EWVASISTGGGNTYYADSVKGRFTISRDNSKNTLYLQMNSLRAED TAVYYCTRHDRGGLYWGQGTMVTVSS |
| 588 | GPRC5D (5F11) VH1d | EVQLVESGGGVVQPGRSLRLSCAASGFSFSNYGMAWVRQAPGKGL EWVASISTGGGNTYYADSVKGRFTISRDNAKNTLYLQMNSLRAED TAVYYCTRHDRGGLYWGQGTMVTVSS |
| 589 | GPRC5D (5F11) VH2b | EVQLVESGGGLVQPGGSLRLSCAASGFSFSNYGMAWVRQAPGKGL EWVASISTGGGNTYYRDSVKGRFTISRDNAKNTLYLQMNSLRAED TAVYYCTRHDRGGLYWGQGTMVTVSS |
| 590 | GPRC5D (5F11) VH2d | EVQLVESGGGLVQPGGSLRLSCAASGFSFSNYGMAWVRQAPGKGL EWVASISTGGGNTYYADSVKGRFTISRDNAKNTLYLQMNSLRAED TAVYYCTRHDRGGLYWGQGTMVTVSS |
| 591 | GPRC5D (5F11) VL1a | DIVMTQSPLSLPVTPGEPASISCRSSKSLLHSNGITYVYWYLQKP GQSPQVLIYRMSNLASGVPDRFSGSGSGTDFTLKISRVEAEDVGV YHCGQLLENPYTFGQGTKLEIK |
| 592 | GPRC5D (5F11) VL1b | DIVMTQSPLSLPVTPGEPASISCRSSKSLLHSNGITYVYWYLQKP GKSPQVLIYRMSNLASGVPDRFSGSGSGTDFTLKISRVEAEDVGV YHCGQLLENPYTFGQGTKLEIK |
| 593 | GPRC5D (5F11) VL2a | DIVMTQSPLSLPVTPGEPASISCRSSKSLLHSNGITYVYWYLQKP GQSPQLLIYRMSNRASGVPDRFSGSGSGTDFTLKISRVEAEDVGV YHCGQLLENPYTFGQGTKLEIK |
| 594 | GPRC5D (5F11) VL2b | DIVMTQSPDSLAVSLGERATINCKSSKSLLHSNGITYVYWYQQKP GQPPKLLIYRMSNLASGVPDRFSGSGSGTDFTLTISSLQAEDVAV YHCGQLLENPYTFGQGTKLEIK |
| 595 | GPRC5D (5F11) VL2c | EIVLTQSPGTLSLSPGERATLSCRASKSLLHSNGITYVYWYQQKP GQAPRLLIYRMSNLASGIPDRFSGSGSGTDFTLTISRLEPEDFAV YHCGQLLENPYTFGQGTKLEIK |
| 596 | CD3 (C122) CDR-H1 | SYAMN |
| 597 | CD3 (C122) CDR-H2 | RIRSKYNNYATYYADSVKG |
| 598 | CD3 (C122) CDR-H3 | HTTFPSSYVSYYGY |
| 599 | CD3 (C122) CDR-L1 | GSSTGAVTTSNYAN |
| 600 | CD3 (C122) CDR-L2 | GTNKRAP |
| 601 | CD3 (C122) CDR-L3 | ALWYSNLWV |
| 602 | CD3 (C122) VH | EVQLLESGGGLVQPGGSLRLSCAASGFQFSSYAMNWVRQAPGKGL EWVSRIRSKYNNYATYYADSVKGRFTISRDDSKNTLYLQMNSLRA EDTAVYYCVRHTTFPSSYVSYYGYWGQGTLVTVSS |
| 603 | CD3 (C122) VL | QAVVTQEPSLTVSPGGTVTLTCGSSTGAVTTSNYANWVQEKPGQA FRGLIGGTNKRAPGTPARFSGSLLGGKAALTLSGAQPEDEAEYYC ALWYSNLWVFGGGTKLTVL |
| 604 | CD3 (V9) CDR-H1 | GYSFTGYTMN |
| 605 | CD3 (V9) CDR-H2 | LINPYKGVSTYNQKFKD |
| 606 | CD3 (V9) CDR-H3 | SGYYGDSDWYFDV |
| 607 | CD3 (V9) CDR-L1 | RASQDIRNYLN |
| 608 | CD3 (V9) CDR-L2 | YTSRLES |
| 609 | CD3 (V9) CDR-L3 | QQGNTLPWT |
| 610 | CD3 (V9) VH | EVQLVESGGGLVQPGGSLRLSCAASGYSFTGYTMNWVRQAPGKGL EWVALINPYKGVSTYNQKFKDRFTISVDKSKNTAYLQMNSLRAED TAVYYCARSGYYGDSDWYFDVWGQGTLVTVSS |
| 611 | CD3 (V9) VL | DIQMTQSPSSLSASVGDRVTITCRASQDIRNYLNWYQQKPGKAPK LLIYYTSRLESGVPSRFSGSGSGTDYTLTISSLQPEDFATYYCQQ GNTLPWTFGQGTKVEIK |

General information regarding the nucleotide sequences of human immunoglobulins light and heavy chains is given in: Kabat, E. A., et al., Sequences of Proteins of Immunological Interest, 5th ed., Public Health Service, National Institutes of Health, Bethesda, Md. (1991). Amino acids of antibody chains are numbered and referred to according to the numbering systems according to Kabat (Kabat, E. A., et al., Sequences of Proteins of Immunological Interest, 5th ed., Public Health Service, National Institutes of Health, Bethesda, Md. (1991)) as defined above.

The following numbered paragraphs (paras) describe aspects of the present invention:

1. A bispecific agonistic CD28 antigen binding molecule characterized by monovalent binding to CD28, comprising
(a) one antigen binding domain capable of specific binding to CD28,
(b) at least one antigen binding domain capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

2. The bispecific agonistic CD28 antigen binding molecule of para 1, wherein the Fc domain is an IgG, particularly an IgG1 Fc domain or an IgG4 Fc domain.

3. The bispecific agonistic CD28 antigen binding molecule of paras 1 or 2, wherein the Fc domain is of human IgG1 subclass and comprises the amino acid mutations L234A, L235A and P329G (numbering according to Kabat EU index).

4. The bispecific agonistic CD28 antigen binding molecule of any one of paras 1 to 3, wherein the antigen binding domain capable of specific binding to CD28 comprises
(i) a heavy chain variable region ($V_H$CD28) comprising a heavy chain complementary determining region CDR-H1 of SEQ ID NO: 20, a CDR-H2 of SEQ ID NO: 21, and a CDR-H3 of SEQ ID NO: 22, and a light chain variable region ($V_L$CD28) comprising a light chain complementary determining region CDR-L1 of SEQ ID NO: 23, a CDR-L2 of SEQ ID NO: 24 and a CDR-L3 of SEQ ID NO: 25; or
(ii) a heavy chain variable region ($V_H$CD28) comprising a CDR-H1 of SEQ ID NO: 36, a CDR-H2 of SEQ ID NO: 37, and a CDR-H3 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

5. The bispecific agonistic CD28 antigen binding molecule of any one of paras 1 to 4, wherein the antigen binding domain capable of specific binding to CD28 comprises a heavy chain variable region ($V_H$CD28) comprising a CDR-H1 of SEQ ID NO: 20, a CDR-H2 of SEQ ID NO: 21, and a CDR-H3 of SEQ ID NO: 22, and a light chain variable region ($V_L$CD28) comprising a CDR-L1 of SEQ ID NO: 23, a CDR-L2 of SEQ ID NO: 24 and a CDR-L3 of SEQ ID NO: 25.

6. The bispecific agonistic CD28 antigen binding molecule of any one of paras 1 to 5, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:26, and a light chain variable region ($V_L$CD28) comprising an amino acid sequence that is at least about 95%, 96%, 97%, 98%, 99% or 100% identical to the amino acid sequence of SEQ ID NO:27.

7. The bispecific agonistic CD28 antigen binding molecule of any one of paras 1 to 4, wherein the antigen binding domain capable of specific binding to CD28 comprises a heavy chain variable region ($V_H$CD28) comprising an amino acid sequence selected from the group consisting of SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50 and SEQ ID NO:51, and a light chain variable region ($V_L$CD28) comprising an amino acid sequence selected from the group consisting of SEQ ID NO:27, SEQ ID NO:52, SEQ ID NO:53, SEQ ID NO:54, SEQ ID NO:55, SEQ ID NO:56, SEQ ID NO:57, SEQ ID NO:58, SEQ 1D NO:59, SEQ ID NO:60 and SEQ ID NO:60.

8. The bispecific agonistic CD28 antigen binding molecule of any one of paras 1 to 4 or 7, wherein the antigen binding domain capable of specific binding to CD28 comprises
(a) a heavy chain variable region ($V_H$CD28) comprising the amino acid sequence of SEQ ID NO:47 and a light chain variable region ($V_L$CD28) comprising the amino acid sequence of SEQ ID NO:54, or
(b) a heavy chain variable region ($V_H$CD28) comprising the amino acid sequence of SEQ ID NO:47 and a light chain variable region ($V_L$CD28) comprising the amino acid sequence of SEQ ID NO:27, or
(c) a heavy chain variable region ($V_H$CD28) comprising the amino acid sequence of SEQ ID NO:51 and a light chain variable region ($V_L$CD28) comprising the amino acid sequence of SEQ ID NO:61, or
(d) a heavy chain variable region ($V_H$CD28) comprising the amino acid sequence of SEQ ID NO:46 and a light chain variable region ($V_L$CD28) comprising the amino acid sequence of SEQ ID NO:53, or
(e) a heavy chain variable region ($V_H$CD28) comprising the amino acid sequence of SEQ ID NO:46 and a light chain variable region ($V_L$CD28) comprising the amino acid sequence of SEQ ID NO:54, or
(f) a heavy chain variable region ($V_H$CD28) comprising the amino acid sequence of SEQ ID NO:46 and a light chain variable region ($V_L$CD28) comprising the amino acid sequence of SEQ ID NO:59, or
(g) a heavy chain variable region ($V_H$CD28) comprising the amino acid sequence of SEQ ID NO:46 and a light chain variable region ($V_L$CD28) comprising the amino acid sequence of SEQ ID NO:27, or
(h) a heavy chain variable region ($V_H$CD28) comprising the amino acid sequence of SEQ ID NO:43 and a light chain variable region ($V_L$CD28) comprising the amino acid sequence of SEQ ID NO:27, or
(i) a heavy chain variable region ($V_H$CD28) comprising the amino acid sequence of SEQ ID NO:42 and a light chain variable region ($V_L$CD28) comprising the amino acid sequence of SEQ ID NO:53, or
(j) a heavy chain variable region ($V_H$CD28) comprising the amino acid sequence of SEQ ID NO:42 and a light chain variable region ($V_L$CD28) comprising the amino acid sequence of SEQ ID NO:59, or
(k) a heavy chain variable region ($V_H$CD28) comprising the amino acid sequence of SEQ ID NO:42 and a light chain variable region ($V_L$CD28) comprising the amino acid sequence of SEQ ID NO:27.

9. The bispecific agonistic CD28 antigen binding molecule of any one of paras 1 to 8, wherein the antigen binding domain capable of specific binding to a tumor-associated antigen is an antigen binding domain capable of specific binding to Carcinoembryonic Antigen (CEA).

10. The bispecific agonistic CD28 antigen binding molecule of any one of paras 1 to 9, wherein the antigen binding domain capable of specific binding to CEA comprises a heavy chain variable region ($V_H$CEA) comprising (i) CDR-H1 comprising the amino acid sequence of SEQ ID NO:127, (ii) CDR-H2 comprising the amino acid sequence of SEQ ID NO:128, and (iii) CDR-H3 comprising the amino acid sequence of SEQ ID NO:129, and a light chain variable region ($V_L$CEA) comprising (iv) CDR-L1 comprising the amino acid sequence of SEQ ID NO:130, (v) CDR-L2 comprising the amino acid sequence of SEQ ID NO:131, and (vi) CDR-L3 comprising the amino acid sequence of SEQ ID NO:132.

11. The bispecific agonistic CD28 antigen binding molecule of any one of paras 1 to 10, wherein the antigen binding domain capable of specific binding to CEA comprises a heavy chain variable region ($V_H$CEA) comprising an amino acid sequence that is at least about 95%, 96%, 97%, 98%, 99% or 100% identical to the amino acid sequence of SEQ ID NO:133, and a light chain variable region ($V_L$CEA) comprising an amino acid sequence that is at least about 95%, 96%, 97%, 98%, 99% or 100% identical to the amino acid sequence of SEQ ID NO:134.

12. The bispecific agonistic CD28 antigen binding molecule of any one of paras 1 to 8, wherein the antigen binding domain capable of specific binding to a tumor-associated antigen is an antigen binding domain capable of specific binding to Fibroblast Activation Protein (FAP).

13. The bispecific agonistic CD28 antigen binding molecule of any one of paras 1 to 8 or 12, wherein the antigen binding domain capable of specific binding to FAP comprises (a) a heavy chain variable region ($V_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region ($V_L$FAP) comprising (iv) CDR-L1 comprising the amino acid sequence of SEQ ID NO:15. (v) CDR-L2 comprising the amino acid sequence of SEQ ID NO:16, and (vi) CDR-L3 comprising the amino acid sequence of SEQ ID NO:17, or (b) a heavy chain variable region ($V_H$FAP) comprising (i) CDR-HI comprising the amino acid sequence of SEQ ID NO:4, (ii) CDR-H2 comprising the amino acid sequence of SEQ ID NO:5, and (iii) CDR-H3 comprising the amino acid sequence of SEQ ID NO:6, and a light chain variable region ($V_L$FAP) comprising (iv) CDR-L1 comprising the amino acid sequence of SEQ ID NO:7, (v) CDR-L2 comprising the amino acid sequence of SEQ ID NO:8, and (vi) CDR-L3 comprising the amino acid sequence of SEQ ID NO:9.

14. The bispecific agonistic CD28 antigen binding molecule of any one of paras 1 to 8 or 12 or 13, wherein the antigen binding domain capable of specific binding to FAP comprises
(a) a heavy chain variable region ($V_H$FAP) comprising an amino acid sequence that is at least about 95%, 96%, 97%, 98%, 99% or 100% identical to the amino acid sequence of SEQ ID NO:18, and a light chain variable region ($V_L$FAP) comprising an amino acid sequence that is at least about 95%, 96%, 97%, 98%, 99% or 100% identical to the amino acid sequence of SEQ ID NO:19, or
(b) a heavy chain variable region ($V_H$FAP) comprising an amino acid sequence that is at least about 95%, 96%, 97%, 98%, 99% or 100% identical to the amino acid sequence of SEQ ID NO:10, and a light chain variable region ($V_L$FAP) comprising an amino acid sequence that is at least about 95%, 96%, 97%, 98%, 99% or 100% identical to the amino acid sequence of SEQ ID NO:11.

15. The bispecific agonistic CD28 antigen binding molecule of any one of paras 1 to 8 or 12 to 14, wherein the antigen binding domain capable of specific binding to FAP comprises a heavy chain variable region ($V_H$FAP) comprising the amino acid sequence of SEQ ID NO:18 and a light chain variable region ($V_L$FAP) comprising the amino acid sequence of SEQ ID NO:19.

16. The bispecific agonistic CD28 antigen binding molecule of any one of paras 1 to 15, wherein the antigen binding domain capable of specific binding to CD28 is a Fab fragment or a crossFab fragment.

17. The bispecific agonistic CD28 antigen binding molecule of any one of paras 1 to 16, comprising
(a) one Fab fragment capable of specific binding to CD28,
(b) one crossFab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function.

18. The bispecific agonistic CD28 antigen binding molecule of any one of paras 1 to 16, comprising
(a) a first Fab fragment capable of specific binding to CD28,
(b) a second Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of one of the Fc domain subunits.

19. The bispecific agonistic CD28 antigen binding molecule of any one of paras 1 to 16, comprising
(a) a first Fab fragment capable of specific binding to CD28,
(b) a second and a third Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

20. The bispecific agonistic CD28 antigen binding molecule of any one of paras 1 to 16, comprising
(a) a Fab fragment capable of specific binding to CD28,
(b) a VII and VL domain capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function, wherein the Fab fragment capable of specific binding to CD28 is fused at its C-terminus to the N-terminus of the first Fc domain subunit, and wherein one of the VH and VL domain capable of specific binding to a tumor-associated antigen is fused via a peptide linker to the C-terminus of the first Fc domain subunit and the other one of the VII and VL domain capable of specific binding to a tumor-associated antigen is fused via a peptide linker to the C-terminus of the second Fc domain subunit.

21. A polynucleotide encoding the bispecific agonistic CD28 antigen binding molecule of any one of paras 1 to 20.

22. A host cell comprising the polynucleotide of claim 21.

23. A method of producing the bispecific agonistic CD28 antigen binding molecule of any one of paras 1 to 20 comprising culturing the host cell of claim 22 under conditions suitable for the expression of the bispecific antigen binding molecule.

24. A pharmaceutical composition comprising the bispecific agonistic CD28 antigen binding molecule of any one of paras 1 to 20 and at least one pharmaceutically acceptable excipient.

25. The pharmaceutical composition of para 24 for use in the treatment of cancer.

26. The bispecific agonistic CD28 antigen binding molecule of any one of paras 1 to 20, or the pharmaceutical composition of para 24, for use as a medicament.

27. The bispecific agonistic CD28 antigen binding molecule of any one of paras 1 to 20, or the pharmaceutical composition of para 24, for use in the treatment of cancer.

28. The bispecific agonistic CD28 antigen binding molecule of any one of paras 1 to 20 for use in the treatment of cancer, wherein the agonistic CD28 antigen binding molecule is administered in combination with a chemotherapeutic agent, radiation therapy and/or other agents for use in cancer immunotherapy.

29. Use of the bispecific agonistic CD28 antigen binding molecule of any one of paras 1 to 20, or the pharmaceutical composition of para 24, in the manufacture of a medicament for the treatment of cancer.

30. A method of inhibiting the growth of tumor cells in an individual comprising administering to the individual an effective amount of the bispecific agonistic CD28 antigen binding molecule of any one of paras 1 to 20, or the pharmaceutical composition of para 24, to inhibit the growth of the tumor cells.

31. A method of treating cancer comprising administering to the individual a therapeutically effective amount of the bispecific agonistic CD28 antigen binding molecule of any one of paras 1 to 20, or the pharmaceutical composition of para 24.

32. A bispecific agonistic CD28 antigen binding molecule comprising an antigen binding domain capable of specific binding to CD28, an antigen binding domain capable of specific binding to a B cell surface antigen, and a Fc domain composed of a first and a second subunit capable of stable association comprising one or more amino acid substitution that reduces the binding affinity of the antigen binding molecule to an Fc receptor and/or effector function.

33. The bispecific agonistic CD28 antigen binding molecule of para 32, characterized by monovalent binding to CD28.

34. The bispecific agonistic CD28 antigen binding molecule of para 32, further characterized by monovalent binding to the B cell surface antigen.

35. The bispecific agonistic CD28 antigen binding molecule of any one of paras 32 to 34, wherein the Fc domain is of human IgG1 subclass and comprises the amino acid mutations L234A, L235A and P329G (numbering according to Kabat EU index).

36. The bispecific agonistic CD28 antigen binding molecule of any one of paras 32 to 35, wherein the antigen binding domain capable of specific binding to CD28 comprises
(i) a heavy chain variable region ($V_H$CD28) comprising a heavy chain complementary determining region CDR-H1 of SEQ ID NO: 20, a CDR-H2 of SEQ ID NO: 21, and a CDR-H3 of SEQ ID NO: 22, and a light chain variable region ($V_L$CD28) comprising a light chain complementary determining region CDR-L1 of SEQ ID NO: 23, a CDR-L2 of SEQ ID NO: 24 and a CDR-L3 of SEQ ID NO: 25; or
(ii) a heavy chain variable region ($V_H$CD28) comprising a CDR-H1 of SEQ ID NO: 36, a CDR-H2 of SEQ ID NO: 37, and a CDR-H3 of SEQ ID NO: 38, and a light chain variable region ($V_L$CD28) comprising a CDR-L1 of SEQ ID NO: 39, a CDR-L2 of SEQ ID NO: 40 and a CDR-L3 of SEQ ID NO: 41.

37. The bispecific agonistic CD28 antigen binding molecule of any one of paras 32 to 36, wherein the antigen binding domain capable of specific binding to CD28 comprises a heavy chain variable region ($V_H$CD28) comprising a CDR-H1 of SEQ ID NO:20, a CDR-H2 of SEQ ID NO:21, and a CDR-H3 of SEQ ID NO:22, and a light chain variable region ($V_L$CD28) comprising a CDR-L1 of SEQ ID NO:23, a CDR-L2 of SEQ ID NO: 24 and a CDR-L3 of SEQ ID NO:25.

38. The bispecific agonistic CD28 antigen binding molecule of any one of paras 32 to 37, wherein the antigen binding domain capable of specific binding to CD28 comprises a heavy chain variable region ($V_H$CD28) comprising an amino acid sequence that is at least about 95%, 96%, 97%, 98%, 99% or 100% identical to the amino acid sequence of SEQ ID NO:26, and a light chain variable region ($V_L$CD28) comprising an amino acid sequence that is at least about 95%, 96%, 97%, 98%, 99% or 100% identical to the amino acid sequence of SEQ ID NO:27.

39. The bispecific agonistic CD28 antigen binding molecule of any one of paras 32 to 36, wherein the antigen binding domain capable of specific binding to CD28 comprises a heavy chain variable region ($V_H$CD28) comprising an amino acid sequence selected from the group consisting of SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50 and SEQ ID NO:51, and a light chain variable region ($V_L$CD28) comprising an amino acid sequence selected from the group consisting of SEQ ID NO:27, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60 and SEQ ID NO:61.

40. The bispecific agonistic CD28 antigen binding molecule of any one of paras 32 to 36 or 39, wherein the antigen binding domain capable of specific binding to CD28 comprises
(a) a heavy chain variable region ($V_H$CD28) comprising the amino acid sequence of SEQ ID NO:47 and a light chain variable region ($V_L$CD28) comprising the amino acid sequence of SEQ ID NO:54, or
(b) a heavy chain variable region ($V_H$CD28) comprising the amino acid sequence of SEQ ID NO:47 and a light chain variable region ($V_L$CD28) comprising the amino acid sequence of SEQ ID NO:27, or (c) a heavy chain variable region ($V_H$CD28) comprising the amino acid sequence of SEQ ID NO:51 and a light chain variable region ($V_L$CD28) comprising the amino acid sequence of SEQ ID NO:61, or (d) a heavy chain variable region ($V_H$CD28) comprising the amino acid sequence of SEQ ID NO:48 and a light chain variable region ($V_L$CD28) comprising the amino acid sequence of SEQ ID NO:53, or (e) a heavy chain variable region ($V_H$CD28) comprising the amino acid sequence of SEQ ID NO:48 and a light chain variable region ($V_L$CD28) comprising the amino acid sequence of SEQ ID NO:54, or (f) a heavy chain variable region ($V_H$CD28) comprising the amino acid sequence of SEQ ID NO:48 and a light chain variable region ($V_L$CD28) comprising the amino acid sequence of SEQ ID NO:59, or (g) a heavy chain variable region ($V_H$CD28) comprising the amino acid sequence of SEQ ID NO:48 and a light chain variable region ($V_L$CD28) comprising the amino acid sequence of SEQ ID NO:27, or (h) a heavy chain variable region ($V_H$CD28) comprising the amino acid sequence of SEQ ID NO:43 and a light chain variable region ($V_L$CD28) comprising the amino acid sequence of SEQ ID NO:27, or (i) a heavy chain variable region ($V_H$CD28) comprising the amino acid sequence of SEQ ID NO:42 and a light chain variable region ($V_L$CD28) comprising the amino acid sequence of SEQ ID NO:53, or (j) a heavy chain variable region ($V_H$CD28) comprising the amino acid sequence of SEQ ID NO:42 and a light chain variable region ($V_L$CD28) comprising the amino acid sequence of SEQ ID NO:59, or (k) a heavy chain variable region ($V_H$CD28) comprising the amino acid sequence of SEQ ID NO:42 and a light chain variable region ($V_L$CD28) comprising the amino acid sequence of SEQ ID NO:27.

41. The bispecific agonistic CD28 antigen binding molecule of any one of paras 32 to 36 or 39 or 40, wherein the antigen binding domain capable of specific binding to CD28 comprises a heavy chain variable region ($V_H$CD28) comprising the amino acid sequence of SEQ ID NO:46 and a light chain variable region ($V_L$CD28) comprising the amino acid sequence of SEQ ID NO:53, or a heavy chain variable region ($V_H$CD28) comprising the amino acid sequence of SEQ ID NO:47 and a light chain variable region ($V_L$CD28) comprising the amino acid sequence of SEQ ID NO:54, or a heavy chain variable region ($V_H$CD28) comprising the amino acid sequence of SEQ ID NO:47 and a light chain variable region ($V_L$CD28) comprising the amino acid sequence of SEQ ID NO:9, or a heavy chain variable region ($V_H$CD28) comprising the amino acid sequence of SEQ ID NO:16 and a light chain variable region ($V_L$CD28) comprising the amino acid sequence of SEQ ID NO:9.

42. The bispecific agonistic CD28 antigen binding molecule of any one of paras 32 to 41, wherein the B cell surface antigen is selected from the group consisting of CD19, CD79b, CD20, CD22 and CD37.

43. The bispecific agonistic CD28 antigen binding molecule of any one of paras 32 to 42, wherein the antigen binding domain capable of specific binding to a B cell surface antigen is an antigen binding domain capable of specific binding to CD19.

44. The bispecific agonistic CD28 antigen binding molecule of any one of paras 32 to 43, wherein the antigen binding domain capable of specific binding to CD19 comprises (a) a heavy chain variable region ($V_H$CD19) comprising (i) CDR-H1 comprising the amino acid sequence of SEQ ID NO:406, (ii) CDR-H2 comprising the amino acid sequence of SEQ ID NO:407, and (iii) CDR-H3 comprising the amino acid sequence of SEQ ID NO:408, and a light chain variable region ($V_L$CD19) comprising (iv) CDR-L1 comprising the amino acid sequence of SEQ ID NO:409, (v) CDR-L2 comprising the amino acid sequence of SEQ ID NO:410, and (vi) CDR-L3 comprising the amino acid sequence of SEQ ID NO:411, or (b) a heavy chain variable region ($V_H$CD19) comprising (i) CDR-H1 comprising the amino acid sequence of SEQ ID NO:414, (ii) CDR-H2 comprising the amino acid sequence of SEQ ID NO:415, and (iii) CDR-H3 comprising the amino acid sequence of SEQ ID NO:416, and a light chain variable region ($V_L$CD19) comprising (iv) CDR-L1 comprising the amino acid sequence of SEQ ID NO:417, (v) CDR-L2 comprising the amino acid sequence of SEQ ID NO:418, and (vi) CDR-L3 comprising the amino acid sequence of SEQ ID NO:419.

45. The bispecific agonistic CD28 antigen binding molecule of any one of paras 32 to 44, wherein the antigen binding domain capable of specific binding to CD19 comprises (a) a heavy chain variable region ($V_H$CD19) comprising an amino acid sequence that is at least about 95%, 98% or 100% identical to the amino acid sequence of SEQ ID NO:412, and a light chain variable region ($V_L$CD19) comprising an amino acid sequence that is at least about 95%, 98% or 100% identical to the amino acid sequence of SEQ ID NO:413, or (b) a heavy chain variable region ($V_H$CD19) comprising an amino acid sequence that is at least about 95%, 98% or 100% identical to the amino acid sequence of SEQ ID NO:420, and a light chain variable region ($V_L$CD19) comprising an amino acid sequence that is at least about 95%, 98% or 100% identical to the amino acid sequence of SEQ ID NO:421.

46. The bispecific agonistic CD28 antigen binding molecule of any one of paras 32 to 45, wherein the antigen binding domain capable of specific binding to CD19 comprises a heavy chain variable region ($V_H$CD19) comprising an amino acid sequence of SEQ ID NO:412 and a light chain variable region ($V_L$CD19) comprising an amino acid sequence of SEQ ID NO:413.

47. The bispecific agonistic CD28 antigen binding molecule of any one of paras 32 to 43, wherein the antigen binding domain capable of specific binding to a B cell surface antigen is an antigen binding domain capable of specific binding to CD79b.

48. The bispecific agonistic CD28 antigen binding molecule of any one of paras 32 to 43 or 47, wherein the antigen binding domain capable of specific binding to CD79b comprises a heavy chain variable region ($V_H$CD79b) comprising (i) CDR-H1 comprising the amino acid sequence of SEQ ID NO:422, (ii) CDR-H2 comprising the amino acid sequence of SEQ ID NO:423, and (iii) CDR-H3 comprising the amino acid sequence of SEQ ID NO:424, and a light chain variable region ($V_L$CD79b) comprising (iv) CDR-L1 comprising the amino acid sequence of SEQ ID NO:425, (v) CDR-L2 comprising the amino acid sequence of SEQ ID NO:426, and (vi) CDR-L3 comprising the amino acid sequence of SEQ ID NO:427.

49. The bispecific agonistic CD28 antigen binding molecule of any one of paras 32 to 43 or 47 or 48, wherein the antigen binding domain capable of specific binding to CD79b comprises a heavy chain variable region ($V_H$CD79b)

comprising an amino acid sequence that is at least about 95%, 98%, or 100% identical to the amino acid sequence of SEQ ID NO:428, and a light chain variable region ($V_L$CD79b) comprising an amino acid sequence that is at least about 95%, 98% or 100% identical to the amino acid sequence of SEQ ID NO:429.

50. The bispecific agonistic CD28 antigen binding molecule of any one of paras 32 to 49, comprising
  (a) one Fab fragment capable of specific binding to CD28,
  (b) one crossFab fragment capable of specific binding to a B cell surface antigen, and
  (c) Fc domain composed of a first and a second subunit capable of stable association comprising one or more amino acid substitution that reduces the binding affinity of the antigen binding molecule to an Fc receptor and/or effector function.

51. The bispecific agonistic CD28 antigen binding molecule of any one of paras 32 to 49, comprising
  (a) a first Fab fragment capable of specific binding to CD28,
  (b) a second Fab fragment capable of specific binding to a B cell surface antigen, and
  (c) a Fc domain composed of a first and a second subunit capable of stable association comprising one or more amino acid substitution that reduces the binding affinity of the antigen binding molecule to an Fc receptor and/or effector function,
  wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of one of the Fc domain subunits.

52. The bispecific agonistic CD28 antigen binding molecule of any one of paras 32 to 49, comprising
  (a) a first Fab fragment capable of specific binding to CD28,
  (b) a second and a third Fab fragment capable of specific binding to a B cell surface antigen, and
  (c) a Fc domain composed of a first and a second subunit capable of stable association comprising one or more amino acid substitution that reduces the binding affinity of the antigen binding molecule to an Fc receptor and/or effector function,
  wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

53. A pharmaceutical composition comprising the bispecific agonistic CD28 antigen binding molecule of any one of paras 32 to 52 and at least one pharmaceutically acceptable excipient.

54. A polynucleotide encoding the bispecific agonistic CD28 antigen binding molecule of any one of paras 32 to 52.

55. A vector comprising the polynucleotide of para 54.

56. A host cell comprising the vector of para 55 or the polynucleotide of para 54.

57. A method of producing the bispecific agonistic CD28 antigen binding molecule of any one of paras 32 to 52 comprising culturing the host cell of para 25 under conditions suitable for the expression of the bispecific antigen binding molecule.

58. The bispecific agonistic CD28 antigen binding molecule of any one of paras 32 to 52, or the pharmaceutical composition of para 53, for use as medicament.

59. The bispecific agonistic CD28 antigen binding molecule of any one of paras 32 to 52, or the pharmaceutical composition of para 53, for use in the treatment of cancer.

60. The bispecific agonistic CD28 antigen binding molecule of any one of paras 32 to 52 for use in the treatment of cancer, wherein the agonistic CD28 antigen binding molecule is for use in combination with a chemotherapeutic agent, radiation therapy and/or other agents for use in cancer immunotherapy.

60. The bispecific agonistic CD28 antigen binding molecule of any one of paras 32 to 52 for use in the treatment of cancer, wherein the agonistic CD28 antigen binding molecule is for use in combination with a T-cell activating anti-CD3 bispecific antibody.

61. The bispecific agonistic CD28 antigen binding molecule of any one of paras 32 to 52 for use in the treatment of cancer, wherein the agonistic CD28 antigen binding molecule is for use in combination with an anti-CD20/anti-CD3 bispecific antibody.

62. The bispecific agonistic CD28 antigen binding molecule of any one of paras 32 to 52 for use in the treatment of cancer, wherein the agonistic CD28 antigen binding molecule is for use in combination with an agent blocking PD-L1/PD-1 interaction.

63. Use of the bispecific agonistic CD28 antigen binding molecule of any one of paras 32 to 52, or the pharmaceutical composition of para 53, in the manufacture of a medicament for the treatment of cancer.

64. A method of inhibiting the growth of tumor cells in an individual comprising administering to the individual an effective amount of the bispecific agonistic CD28 antigen binding molecule of any one of paras 32 to 52, or the pharmaceutical composition of para 53, to inhibit the growth of the tumor cells.

65. A method of treating cancer comprising administering to the individual a therapeutically effective amount of the bispecific agonistic CD28 antigen binding molecule of any one of paras 32 to 52, or the pharmaceutical composition of para 53.

EXAMPLES

The following are examples of methods and compositions of the invention. It is understood that various other embodiments may be practiced, given the general description provided above.

Recombinant DNA Techniques

Standard methods were used to manipulate DNA as described in Sambrook et al.,

Molecular cloning: A laboratory manual; Cold Spring Harbor Laboratory Press, Cold Spring Harbor, N.Y., 1989. The molecular biological reagents were used according to the manufacturer's instructions. General information regarding the nucleotide sequences of human immunoglobulin light and heavy chains is given in: Kabat, E. A. et al., (1991) Sequences of Proteins of Immunological Interest, Fifth Ed., Publication No 91-3242.

DNA Sequencing

DNA sequences were determined by double strand sequencing.

Gene Synthesis

Desired gene segments, where required, were either generated by PCR using appropriate templates or were synthesized at Geneart AG (Regensburg, Germany) or Genscript (New Jersey, USA) from synthetic oligonucleotides and PCR products by automated gene synthesis. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow subcloning into the respective expression vectors. All constructs were designed with a 5'-end DNA sequence coding for a leader peptide which targets proteins for secretion in eukaryotic cells.

Cell Culture Techniques

Standard cell culture techniques were used as described in Current Protocols in Cell Biology (2000), Bonifacino, J. S., Dasso, M., Harford, J. B., Lippincott-Schwartz, J. and Yamada, K. M. (eds.), John Wiley & Sons, Inc.

Protein Purification

Proteins were purified from filtered cell culture supernatants referring to standard protocols. In brief, antibodies were applied to a Protein A Sepharose column (GE healthcare) and washed with PBS. Elution of antibodies was achieved at pH 2.8 followed by immediate neutralization of the sample. Aggregated protein was separated from monomeric antibodies by size exclusion chromatography (Superdex 200, GE Healthcare) in PBS or in 20 mM Histidine, 150 mM NaCl pH 6.0. Monomeric antibody fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

SDS-PAGE

The NuPAGE® Pre-Cast gel system (Invitrogen) was used according to the manufacturer's instruction. In particular, 10% or 4-12% NuPAGE® Novex® Bis-TRIS Pre-Cast gels (pH 6.4) and a NuPAGE® MES (reduced gels, with NuPAGE® Antioxidant running buffer additive) or MOPS (non-reduced gels) running buffer was used.

Analytical Size Exclusion Chromatography

Size exclusion chromatography (SEC) for the determination of the aggregation and oligomeric state of antibodies was performed by HPLC chromatography. Briefly, Protein A purified antibodies were applied to a Tosoh TSKgel G3000SW column in 300 mM NaCl, 50 mM $KH_2PO_4$/$K_2HPO_4$, pH 7.5 on an Agilent HPLC 1100 system or to a Superdex 200 column (GE Healthcare) in 2×PBS on a Dionex HPLC-System. The eluted protein was quantified by UV absorbance and integration of peak areas. BioRad Gel Filtration Standard 151-1901 served as a standard.

Mass Spectrometry

This section describes the characterization of the multi-specific antibodies with VH/VL exchange (VH/VL CrossMabs) with emphasis on their correct assembly. The expected primary structures were analyzed by electrospray ionization mass spectrometry (ESI-MS) of the deglycosylated intact CrossMabs and deglycosylated/plasmin digested or alternatively deglycosylated/limited LysC digested CrossMabs.

The VH/VL CrossMabs were deglycosylated with N-Glycosidase F in a phosphate or Tris buffer at 37° C. for up to 17 h at a protein concentration of 1 mg/ml. The plasmin or limited LysC (Roche) digestions were performed with 100 µg deglycosylated VH/VL CrossMabs in a Tris buffer pH 8 at room temperature for 120 hours and at 37° C. for 40 min, respectively. Prior to mass spectrometry the samples were desalted via HPLC on a Sephadex G25 column (GE Healthcare). The total mass was determined via ESI-MS on a maXis 4G UHR-QTOF MS system (Bruker Daltonik) equipped with a TriVersaNanoMate source (Advion).

Determination of Binding and Binding Affinity of Multi-specific Antibodies to the Respective Antigens Using Surface Plasmon Resonance (SPR) (BIACORE)

Binding of the generated antibodies to the respective antigens is investigated by surface plasmon resonance using a BIACORE instrument (GE Healthcare Biosciences AB, Uppsala, Sweden). Briefly, for affinity measurements Goat-Anti-Human IgG, JIR 109-005-098 antibodies are immobilized on a CM5 chip via amine coupling for presentation of the antibodies against the respective antigen. Binding is measured in HBS buffer (HBS-P (10 mM HEPES, 150 mM NaCl, 0.005% Tween 20, ph 7.4), 25° C. (or alternatively at 37° C.). Antigen (R&D Systems or in house purified) was added in various concentrations in solution. Association was measured by an antigen injection of 80 seconds to 3 minutes; dissociation was measured by washing the chip surface with HBS buffer for 3-10 minutes and a KD value was estimated using a 1:1 Langmuir binding model. Negative control data (e.g. buffer curves) are subtracted from sample curves for correction of system intrinsic baseline drift and for noise signal reduction. The respective Biacore Evaluation Software is used for analysis of sensorgrams and for calculation of affinity data.

Example 1

Generation and Production of Bispecific Antigen Binding Molecules Targeting CD28 and Fibroblast Activation Protein (FAP) or Carcinoembryonic Antigen (CEA)

1.1 Cloning of Bispecific Antigen Binding Molecules Targeting CD28 and Fibroblast Activation Protein (FAP) or Carcinoembryonic Antigen (CEA)

Cloning of the Antigen:

A DNA fragment encoding the extracellular domain (amino acids 1 to 134 of matured protein) of human CD28 (Uniprot: P10747) was inserted in frame into two different mammalian recipient vectors upstream of a fragment encoding a hum IgG1 Fc fragment which serves as solubility- and purification tag. One of the expression vectors contained the "hole" mutations in the Fc region, the other one the "knob" mutations as well as a C-terminal avi tag (GLNDIFEAQK-IEWHE, SEQ ID NO:387) allowing specific biotinylation during co-expression with Bir A biotin ligase. In addition, both Fc fragments contained the PG-LALA mutations. Both vectors were co-transfected in combination with a plasmid coding for the BirA biotin ligase in order to get a dimeric CD28-Fc construct with a monovalent biotinylated avi-tag at the C-terminal end of the Fc-knob chain.

The variable domains of the FAP clone 4B9, a CEA binder and the CD28 clones SA and mAb 9.3 were used for the generation of various tumor targeted CD28 constructs. The generation and preparation of FAP clone 4B9 is disclosed in WO 2012/020006 A2, which is incorporated herein by reference. The CEA clone used in the molecules is described in WO 2007/071422 and the CD28 superagonistic antibody (SA) with a VH comprising the amino acid sequence of SEQ ID NO:26 and a VL comprising the amino acid sequence of SEQ ID NO:27 is described in WO 2006/050949. A description of antibody mAb 9.3 can be found in Tan et al. J. Immunology 2002, 169, 1119-1125. For the generation of the respective expression plasmids, the sequences of the respective variable domains were used and sub-cloned in frame with the respective constant regions which are pre-inserted in the respective recipient mammalian expression vector. A schematic description of the resulting molecules is shown in FIGS. 1A to 1M. Where indicated, Pro329Gly, Leu234Ala and Leu235Ala mutations (PG-LALA) have been introduced in the constant region of the human IgG1 heavy chains to abrogate binding to Fc gamma receptors. For the generation of unsymmetric bispecific antibodies, Fc-fragments contained either the "knob" or "hole" mutations to avoid mispairing of the heavy chains. In order to avoid mispairing of light chains in bi- and multispecific antibody constructs, exchange of VH/VL or CH1/Ckappa domains was introduced in one binding moiety (CrossFab technology). In another binding moiety, charges were introduced into the CH1 and Ckappa domains.

The following molecules were cloned, a schematic illustration thereof is shown in FIGS. 1A to 1M:

Molecule A: CD28(SA) (huIgG4), TGN1412, CD28 (SA) antibody in a human IgG4 isotype (FIG. 1A), comprises the amino acid sequences of SEQ ID NO:62 and SEQ ID NO:63 (P1AE1975).

Molecule B: CD28(SA) (PG-LALA), CD28 (SA) antibody in a huIgG1 PG-LALA isotype (FIG. 1B) comprises the amino acid sequences of SEQ ID NO:62 and SEQ ID NO:64 (P1AD9289).

Molecule C: FAP(4B9)-CD28(SA) 1+1 format, bispecific huIgG1 PG-LALA CrossFab molecule with charged modifications in the CD28(SA) Fab fragment (knob) and VH/VL exchange in FAP(4B9) Fab fragment (hole) (FIG. 1C) comprising the amino acid sequences of SEQ ID NOs: 65, 66, 67 and 68 (P1AD4492).

Molecule D: FAP(4B9)-CD28(SA) 1+4 format, bispecific tetravalent anti-CD28 (SA) and monovalent anti-FAP huIgG1 PG-LALA construct. The VH and VL domains of the FAP clone 4B9 were fused to the C-terminal end of respective chains of the Fc domain (VH: knob chain, VL: hole chain) (FIG. 1F). The molecule comprises the amino acid sequences of SEQ ID NOs: 62, 69 and 70 (P1AD9018).

Molecule E: FAP(4B9)-CD28(SA) 1+2 format, bispecific bivalent anti-CD28 (SA) and monovalent anti-FAP huIgG1 PG-LALA construct. The VH and VL domains of the FAP clone 4B9 were fused to the C-terminal end of respective chains of the Fc domain (VH: knob chain, VL: hole chain) (FIG. 1D). The molecule comprises the amino acid sequences of SEQ ID NOs: 62, 71 and 72 (P1AD9011).

Molecule F: FAP(4B9)-CD28(SA) 2+2, bispecific bivalent anti-CD28 (SA) and bivalent anti-FAP huIgG1 PG-LALA CrossFab construct, charged modifications in the anti-CD28 Fab fragments, VH fusion of the anti-FAP CrossFab fragments with CH1/Ckappa exchange to the C-terminal end of the Fc fragment (FIG. 1E). The molecule comprises the amino acid sequences of SEQ ID NOs:65, 73 and 74 (P1AD4493).

Molecule G: FAP (4B9)-CD28 (SA) 2+1, bispecific monovalent anti-CD28 (SA) and bivalent anti-FAP huIgG1 PG-LALA CrossFab construct, "classical orientation", VH/VL exchange in the anti-CD28 CrossFab fragment, charged modification in anti-FAP Fab fragments (FIG. 1L). The molecule comprises the amino acid sequences of SEQ ID NOs: 75, 76, 77 and 78 (P1AD5231).

Molecule H: FAP(4B9)—CD28(SA)C-01, 1+1 bispecific monovalent anti-CD28 (SA) and monovalent anti-FAP huIgG1 PG-LALA CrossFab molecule, "head-to-tail", VH/VL exchange in anti-CD28 CrossFab fragment, charged modification in anti-FAP binder (FIG. 1M). The molecule comprises the amino acid sequences of SEQ ID NOs: 75, 77, 78 and 79 (P1AE2021).

Molecule I: FAP(4B9)—CD28(SA)C-04, 1+1 bispecific monovalent anti-CD28 (SA) and monovalent anti-FAP huIgG1 PG-LALA construct. The VH and VL domains of the FAP binder 4B9 were fused to the C-terminal end of respective chains of the Fc fragment (VH: knob chain, VL: hole chain) (FIG. 1K). The molecule comprises the amino acid sequences of SEQ ID NOs: SEQ ID NO: 62, 72 and 80 (P1AE2236).

Molecule J: CEA-CD28(SA) 2+2, bispecific bivalent anti-CD28 (SA) and bivalent anti-CEA huIgG1 PG-LALA CrossFab construct, charged modifications in the anti-CD28 Fab fragments, VH fusion of the anti-CEA CrossFab fragment with CH1/Ckappa exchange to the C-terminal end of the Fc fragment (FIG. 1H). The molecule comprises the amino acid sequences of SEQ ID NOs: 65, 81 and 82 (P1AE1195).

Molecule K: CEA-CD28(SA) 1+2, bispecific bivalent anti-CD28 (SA) and monovalent anti-CEA huIgG1 PG-LALA construct. The VH and VL domains of the CEA binder were fused to the C-terminal end of respective chains of the Fc fragment (VH: knob chain, VL: hole chain) (FIG. 1G). The molecule comprises the amino acid sequences of SEQ ID NOs: 62, 83 and 84 (P1AE1194).

Molecule L: monovalent IgG CD28 (SA), monovalent anti-CD28 (SA) huIgG1 PG-LALA construct, wherein the CD28 heavy chain is expressed as a "hole" Fc chain in combination with a Fc (knob) fragment (FIG. 1I). The molecule comprises the amino acid sequences of SEQ ID NOs: 65, 85 and 86 (P1AD8944).

Molecule M: CEA-CD28(SA) 1+1 format, bispecific huIgG1 PG-LALA CrossFab molecule with charged modifications in the CD28(SA) Fab fragment (knob) and VH/VL exchange in CEA crossFab fragment (hole) (FIG. 1.1) comprising the amino acid sequences of SEQ ID NOs: 65, 66, 87 and 88 (P1AE3127).

Molecule N: mab 9.3 (PG-LALA), mAb9.3 clone in human IgG1 PG-LALA isotype (as in FIG. 1B). The molecule comprises the amino acid sequences of SEQ ID NOs: 89 and 90 (P1AD5142).

Molecule O: FAP(4B9)—CD28(mAb9.3)C-03, bispecific huIgG1 PG-LALA CrossFab construct with charged modifications in the mAb9.3 Fab fragment (knob) and VH/VL exchange in the anti-FAP fragment (hole) (as in FIG. 1C). The molecule comprises the amino acid sequences of SEQ ID NOs: 67, 68, 91 and 92 (P1AE2238).

Molecule P: FAP(4B9)-CD28(mAb9.3) 1+4, bispecific tetravalent anti-CD28 mAb9.3 and anti-FAP huIgG1 PG-LALA construct. The VH and VL domains of the FAP binder are fused to the C-terminal end of respective chains of the Fc fragment (VH: knob chain, VL: hole chain) (as in FIG. 1F). The molecule comprises the amino acid sequences of SEQ ID NOs: 89, 93 and 94 (P1AD8969).

Molecule Q: FAP(4B9)-CD28(mAb9.3) 1+2, bispecific bivalent anti-CD28 mAb9.3 and monovalent anti-FAP huIgG1 PG-LALA construct. The VH and VL domains of the FAP binder were fused to the C-terminal end of respective chains of the Fc fragment (VH: knob chain, VL: hole chain) (as in FIG. 1D). The molecule comprises the amino acid sequences of SEQ ID Nos: 89, 95 and 96 (P1AD8962).

Molecule R: FAP(4B9)-CD28(mAb9.3) 2+2, bispecific bivalent anti-CD28 mAb9.3 and bivalent anti-FAP huIgG1 PG-LALA CrossFab construct, charged modifications in the mAb9.3 FAP fragment, VH fusion of the anti-FAP Fab fragment with CH1/Ckappa CrossFab exchange to the C-terminal end of the Fc fragment (as in FIG. 1E). The molecule comprises the amino acid sequences of SEQ ID Nos: 97, 98 and 99 (P1AD8968).

Molecule S: FAP (4B9)-CD28(mAb9.3) 2+1, bispecific monovalent anti-CD28 (mAb9.3) and bivalent anti-FAP huIgG1 PG-LALA CrossFab construct, "classical orientation", VH/VL exchange in the anti-CD28 (mAb9.3) CrossFab fragment, charged modification in anti-FAP Fab fragments (as in FIG. 1L). The molecule comprises the amino acid sequences of SEQ ID Nos: 76, 77, 100 and 101 (P1AD5560).

Molecule T: FAP(4B9)—CD28(mAb9.3)C-02, bispecific monovalent anti-CD28 (mAb9.3) and monovalent anti-FAP huIgG1 PG-LALA CrossFab construct, "head-to-tail", VH/VL exchange in the anti-CD28 (mAb9.3) CrossFab fragment, charged modification in the anti-FAP fragment (as in FIG. 1M). The molecule comprises the amino acid sequences of SEQ ID Nos: 78, 79, 100 and 101 (P1AE2022).

Molecule U: FAP(4B9)—CD28(mAb9.3)C-05, bispecific monovalent anti-CD28 (mAb9.3) and monovalent anti-FAP huIgG1 PG-LALA construct. The VH and VL domains of the FAP binder 4B9 were fused to the C-terminal end of respective chains of the Fc fragment (VH: Fc knob chain, VL: Fc hole chain) (as in FIG. 1K). The molecule comprises the amino acid sequences of SEQ ID Nos: 80, 89 and 96 (P1AE2237).

Molecule V: CEA-CD28(mAb9.3) 2+2, bispecific bivalent anti-CD28 (mAb9.3) and bivalent anti-CEA huIgG1 PG-LALA CrossFab construct, charged modifications in the mAb9.3 Fab fragment, VH fusion of the anti-CEA CrossFab fragment with CH1/Ckappa exchange to the C-terminal end of the Fc fragment (as in FIG. 1H). The molecule comprises the amino acid sequences of SEQ ID Nos: 82, 89 and 102 (P1AE1193).

Molecule W: CEA-CD28(mAb9.3) 1+2, bispecific bivalent anti-CD28 (mAb9.3) and monovalent anti-CEA huIgG1 PG-LALA construct. The VH and VL domains of the CEA binder were fused to the C-terminal end of respective chains of the Fc fragment (VH: knob chain, VL: hole chain) (as in FIG. 1G). The molecule comprises the amino acid sequences of SEQ ID Nos: 89, 103 and 104 (P1AE1192).

Molecule X: monovalent IgG CD28 (mAb9.3), wherein the CD28 heavy chain is expressed as a "hole" Fc chain in combination with a Fc (knob) fragment (as in FIG. 1I). The molecule comprises the amino acid sequences of SEQ ID Nos: 86, 105 and 106 (P1AD8938).

Furthermore, a trispecific molecule was prepared:

Molecule Y, FAP (4B9)-CD28(TGN1412)-CEA 1+1+1, trispecific monovalent anti-CD28 (TGN1412), monovalent anti-FAP and monovalent anti-CEA huIgG1 PG-LALA CrossFab construct, VH/VL exchange in the anti-CEA CrossFab fragment (hole), charged modifications in the anti-FAP Fab fragment (knob) and in the anti-CD28 fragment (knob) (as in FIG. 1N). The molecule comprises the amino acid sequences of SEQ ID Nos: 87, 88, 388 and 389 (P1AE4064).

1.2 Production of Bispecific Antigen Binding Molecules Targeting CD28 and Fibroblast Activation Protein (FAP) or Carcinoembryonic Antigen (CEA)

Expression of the above-mentioned molecules is either driven by a chimeric MPSV promoter or a CMV promoter. Polyadenylation is driven by a synthetic polyA signal sequence located at the 3' end of the CDS. In addition, each vector contains an EBV OriP sequence for autosomal replication.

For the production of the constructs C to W, HEK293-EBNA cells that grow in suspension were co-transfected with the respective expression vectors using polyethylenimine as a transfection reagent. Antibodies and bispecific antibodies were generated by transient transfection of HEK293 EBNA cells. Cells were centrifuged and medium replaced by pre-warmed CD CHO medium. Expression vectors were mixed in CD CHO medium, PEI was added, the solution vortexed and incubated for 10 minutes at room temperature. Afterwards, cells were mixed with the DNA/PEI solution, transferred to shake flask and incubated for 3 hours at 37° C. in an incubator with a 5% $CO_2$ atmosphere. After the incubation, Excell medium with supplements was added (Mammalian Cell Cultures for Biologics Manufacturing, Editors: Weichang Zhou, Anne Kantardjieff). One day after transfection supplements (Feed) were added (Mammalian Cell Cultures for Biologics Manufacturing, Editors: Weichang Zhou, Anne Kantardjieff). Cell supernatants were harvested after 7 days by centrifugation and subsequent filtration (0.2 μm filter) and purified by standard methods.

Constructs A, B and X were prepared by Evitria using their proprietary vector system with conventional (non-PCR based) cloning techniques and using suspension-adapted CHO K1 cells (originally received from ATCC and adapted to serum-free growth in suspension culture at Evitria). For the production, Evitria used its proprietary, animal-component free and serum-free media (eviGrow and eviMake2) and its proprietary transfection reagent (eviFect). Supernatant was harvested by centrifugation and subsequent filtration (0.2 μm filter) and purified by standard methods.

1.3 Purification of Bispecific Antigen Binding Molecules Targeting CD28 and Fibroblast Activation Protein (FAP) or Carcinoembryonic Antigen (CEA)

Proteins were purified from filtered cell culture supernatants referring to standard protocols. In brief, Fc-containing proteins were purified from cell culture supernatants by affinity chromatography using Protein A. Elution was achieved at pH 3.0 followed by immediate neutralization of the sample. The protein was concentrated and aggregated protein was separated from monomeric protein by size exclusion chromatography in 20 mM histidine, 140 mM sodium chloride, pH 6.0.

1.4 Analytical Data of Bispecific or Trispecific Antibodies Targeting CD28 and Fibroblast Activation Protein (FAP) or Carcinoembryonic Antigen (CEA)

The protein concentration of purified constructs was determined by measuring the optical density (OD) at 280 nm, using the mass extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII (Perkin Elmer). Determination of the aggregate content was performed by HPLC chromatography at 25° C. using analytical size-exclusion column (TSKgel G3000 SW XL or UP-SW3000) equilibrated in running buffer (25 mM $K_2HPO_4$, 125 mM NaCl, 200 mM L-Arginine Monohydrocloride, pH 6.7 or 200 mM $KH_2PO_4$, 250 mM KCl pH 6.2 respectively). A summary of the purification parameters of all molecules is given in Table 1.

TABLE 1

Summary of the production and purification of bispecific or trispecific CD28 antigen binding molecules

| Molecule | Description | Yield [mg/l] | Analytical SEC (HMW/ Monomer/ LMW) [%] | Purity measured by CE-SDS [%] |
|---|---|---|---|---|
| A | CD28(SA) (hu IgG4) | 257 | 0/100/0 | 84.25 |
| B | CD28(SA) hu IgG1 (PG-LALA) | 390 | 0/97.3/2.7 | 84 |
| C | FAP(4B9) – CD28(SA) 1 + 1 | 19.5 | 0.64/97.28/2.07 | 98.75 |
| D | FAP(4B9) – CD28(TGN1412) 1 + 4 | 1.75 | 3.53/96.48/0 | n.d. |
| E | FAP(4B9) – CD28(SA) 1 + 2 | 0.38 | 0.8/95.48/3.72 | 93.58 |
| F | FAP(4B9) – CD28(SA) 2 + 2 | 18.2 | 1.4/98.6/0 | 91.42 |
| G | FAP (4B9) – CD28 (SA) 2 + 1 | 2.66 | 3.79/94.02/2.19 | 64 |
| H | FAP(4B9) – CD28(SA) C-01 | 10.6 | 0/100/0 | 99.38 |
| I | FAP(4B9) – CD28(SA) C-04 | 5.55 | 4.12/81.17/14.71 | 96.5 |
| J | CEA – CD28(SA) 2 + 2 | 6.25 | 1/99/0 | n.d. |
| K | CEA – CD28(SA) 1 + 2 | 5.8 | 0.5/99.5/0 | 64 |
| L | monovalent IgG1 CD28 (SA) | 38.5 | 0.2/99.6/0.2 | 99.3 |
| M | CEA – CD28(SA) 1 + 1 | 14.3 | 0/100/0 | 99.18 |
| N | CD28 (mAb 9.3) hu IgG1 (PG-LALA) | 22.06 | 0/100/0 | 88 |
| O | FAP(4B9) – CD28(mAb9.3) C-03 | 2.14 | 0/100/0 | 97.4 |
| P | FAP(4B9) – CD28(mAb9.3) 1 + 4 | 7.6 | 1.2/98.8/0 | 97.6 |
| Q | FAP(4B9) – CD28(mAb9.3) 1 + 2 | 16. | 1/98.5/0.5 | 97.16 |
| R | FAP(4B9) – CD28(mAb9.3) 2 + 2 | 3.9 | 0/95.5/4.5 | 87 |
| S | FAP (4B9) – CD28 (mAb9.3) 2 + 1 | 2.63 | 2.1/96.3/1.6 | 90.55 |
| T | FAP(4B9) – CD28(mAb9.3) C-02 | 2.3 | 0/100/0 | 100 |
| U | FAP(4B9) – CD28(mAb9.3) C-05 | 23.78 | 0.68/97.82/1.5 | 96.1 |
| V | CEA – CD28(mAb9.3) 2 + 2 | 3.1 | 0/100/0 | 100 |
| W | CEA – CD28(mAb9.3) 1 + 2 | 2.25 | 0/100/0 | 92.8 |
| X | monovalent IgG1 CD28 (mAb9.3) | 20.2 | 1.4/98.6/0 | 97.7 |
| Y | FAP(4B9) – CD28(TGN1412) – CEA 1 + 1 + 1 | 1.57 | 0/100/0 | 100 |

Example 2

Binding and Kinetic Analysis of Bispecific Antibodies of Bispecific Antigen Binding Molecules Targeting CD28 and Fibroblast Activation Protein (FAP) or Carcinoembryonic Antigen (CEA)

2.1 Binding of Bispecific Antibodies Targeting CD28 and Fibroblast Activation Protein (FAP) to FAP- or CEA- and to CD28-Expressing Cells The binding of bispecific FAP-CD28 molecules was tested using human fibroblast activating protein (huFAP) expressing 3T3-huFAP cells (clone 19). This cell line was generated by the transfection of the mouse embryonic fibroblast NIH/3T3 cell line (ATCC CRL-1658) with the expression vector pETR4921 to express huFAP under 1.5 µg/mL Puromycin selection. The binding to human CD28 was tested with CHO cells expressing human CD28 (parental cell line CHO-kl ATCC #CCL-61, modified to stably overexpress human CD28). The binding to human CEACAM5 was tested with CEA-expressing MKN45 cells (gastric cancer cell line, DSMZ #ACC 409).

To assess binding, cells were harvested, counted, checked for viability and re-suspended at 2.5E5/ml in FACS buffer (eBioscience, Cat No 00-4222-26). $5 \times 10^4$ cells were incubated in round-bottom 96-well plates for 2 h at 4° C. with increasing concentrations of the FAP-targeted CD28 constructs (1 pM-100 nM). Then, cells were washed three times with cold FACS buffer, incubated for further 60 min at 4° C. with PE-conjugated, goat-anti human PE (Jackson ImmunoReserach, Cat No 109-116-098), washed once with cold FACS buffer, centrifuged and resuspended in 100 µl FACS buffer. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism6.

The FAP-CD28 molecules were able to bind to both human FAP as well as human CD28 on cells in a concentration dependent manner (FIGS. 2B and 2C for certain examples). As expected, no binding was detected with the anti-DP47 IgG, indicating that the detection of binding is due to specific CD28 and FAP binding by the respective targeting moieties.

CEA-CD28 molecules were also able to bind to both human CEA as well as human CD28 on cells.

2.2 Kinetic Analysis of Bispecific or Trispecific Antibodies Targeting CD28 and CEA Affinity ($K_D$) of both binding moieties of the bispecific or trispecific antibodies comprising anti-CEA (Medi-565) and anti-CD28 was measured by SPR using a ProteOn XPR36 instrument (Biorad) at 25° C. with biotinylated huCD28-Fc antigen and biotinylated Hu N(A2-B2)A-avi-His immobilized on an NLC chip by neutravidin capture.

For the generation of a CEACAM5-based antigen that contains the epitope for CEA(Medi-565), a chimeric protein consisting of two CEACAM1 and two CEACAM5 Ig domains was generated. Based on the sequence of CEACAM1, the second and third domain of CEACAM1 was replaced by the CEACAM5 domains A2 and B2. A C-terminal avi-tag and His tag were fused for site-specific biotinylation and purification. The resulting protein was named Hu N(A2-B2)A-avi-His (SEQ ID NO: 169).

Immobilization of recombinant antigens (ligand): Antigens were diluted with PBST (10 mM phosphate, 150 mM sodium chloride pH 7.4, 0.005% Tween 20) to 10 µg/ml, then injected at 30 µl/minute at varying contact times, to achieve immobilization levels of about 400, 800, and 1600 response units (RU) in vertical orientation. Injection of analytes: For one-shot kinetics measurements, injection direction was changed to horizontal orientation, two-fold dilution series of the purified bispecific CEA-targeted anti-CD28 bispecific antibody (varying concentration ranges between 50 and 3.125 nM) were injected simultaneously at 50 µl/min along separate channels 1-5, with association times of 150s, and dissociation times of 450s. Buffer (PBST) was injected along the sixth channel to provide an "in-line" blank for referencing. Association rate constants (kon) and dissociation rate constants (koff) were calculated using a simple one-to-one Langmuir binding model in ProteOn Manager v3.1 software by simultaneously fitting the association and dissociation sensorgrams. The equilibrium dissociation constant ($K_D$) was calculated as the ratio koff/kon. Calculated $K_D$ values of a bispecific antibody comprising one anti-CD28 antigen binding domain and one anti-CEA antigen binding domain (Molecule M) are in line with the measured values of the respective monospecific constructs. The kinetic and thermodynamic data are summarized in Table 2 below.

TABLE 2 kinetic and thermodynamic analysis
of CEA-CD28(SA) 1 + 1 (Molecule M)

| Binding moiety | $k_{on}$ (1/(s*M)) | $k_{off}$ (1/s) | $K_D$ (nM) |
|---|---|---|---|
| Anti-CEA | 4.13 exp5 | 1.2 exp-4 | 0.29 |
| Anti-CD28 (TGN1412) | 3.13 exp5 | 3.76 exp-4 | 1.2 |

Example 3

Generation and Characterization of CD28 (SA) Variants Devoid of Hotspots and Reduced in Affinity 3.1 Removal of an Unpaired Cysteine Residue, Tryptophan Residues, a Deamidation Site and Generation of Affinity-Reduced CD28 (SA) Variants As part of our detailed binder characterization, a computational analysis of the CD28(SA) variable domain sequences was performed. This analysis revealed an unpaired cysteine in the CDR2 region of VH (position 50, Kabat numbering), tryptophan residues in CDR3 of VH (position 100a, Kabat numbering) and CDR1 of VL (position 32, Kabat numbering), and a potential asparagine deamidation site in CDR2 of VH (position 56, Kabat numbering). While oxidation of tryptophan is a rather slow process and can be prevented by adding reducing compounds, the presence of unpaired cysteines in an antibody variable domain can be critical. Free cysteines are reactive and can form stable bonds with other unpaired cysteines of other proteins or components of the cell or media. As a consequence, this can lead to a heterogeneous and instable product with unknown modifications which are potentially immunogenic and therefore may pose a risk for the patients. In addition, deamidation of asparagine and the resulting formation of iso-aspartate and succinimide can affect both in vitro stability and in vivo biological functions. A crystal structure analysis of the parental murine binder 5.11A revealed that C50 is not involved in binding to human CD28 and therefore can be replaced by a similar amino acid such as serine without affecting the affinity to CD28 (Table 6, variant 29). Both tryptophan residues as well as asparagine at position 50, however, are close to or involved in the binding interface and a replacement by a similar amino acid can therefore lead to a reduction of the binding affinity. In this example, we particularly aimed at reducing the affinity of CD28(SA) to human CD28 because of the following reason: The affinity of CD28(SA) is in the range of 1-2 nM with a binding half-life of about 32 minutes. This strong affinity can lead to a sink effect in tissue containing large amounts of CD28-expressing cells such as blood and lymphatic tissue when injected intravenously into patients. As a consequence, site-specific targeting of the compound via the targeting component(s) FAP and/or CEA may be reduced and the efficacy of the construct can be diminished. In order to minimize such an effect, several VH and VL variants were generated in order to reduce to affinities to different degrees (FIGS. 3A and 3C). Besides the previously mentioned positions that represent potential stability hotspots, additional residues involved directly or indirectly in the binding to human CD28 were replaced either by the original murine germline amino acid or by a similar amino acid. In addition, the CDRs of both CD28(SA) VL and VH were also grafted into the respective framework sequences of trastuzumab (FIGS. 3B and 3D). Several combinations of VH and VL variants were then expressed as monovalent one-armed anti-CD28 IgG-like constructs and binding was characterized by SPR.

3.2 Analysis of the Dissociation Rate Constants ($k_{off}$) of Reduced One-Armed Anti-CD28 Variants by SPR In order to characterize the anti-CD28 binder variants in a first step, all binders were expressed as monovalent one-armed IgG-like constructs (FIG. 4A). This format was chosen in order to characterize the binding to CD28 in a 1:1 model. 5 days after transfection into HEK cells, the supernatant was harvested and the titer of the expressed constructs was determined.

The off-rate of the anti-CD28 binder variants was determined by surface plasmon resonance (SPR) using a ProteOn XPR36 instrument (Biorad) at 25° C. with biotinylated huCD28-Fc antigen immobilized on NLC chips by neutravidin capture. For the immobilization of recombinant antigen (ligand), huCD28-Fc was diluted with PBST (Phophate buffered saline with Tween 20 consisting of 10 mM phosphate, 150 mM sodium chloride pH 7.4, 0.005% Tween 20) to concentrations ranging from 100 to 500 nM, then injected at 25 µl/minute at varying contact times. This resulted in immobilization levels between 1000 to 3000 response units (RU) in vertical orientation.

For one-shot kinetics measurements, injection direction was changed to horizontal orientation. Based on the titer of the produced supernatants, the monovalent one-armed IgGs were diluted with PBST to get two-fold dilution series ranging from 100 nM to 6.25 nM. Injection was performed simultaneously at 50 µl/min along separate channels 1-5, with association times of 120s, and dissociation times of 300s. Buffer (PBST) was injected along the sixth channel to provide an "in-line" blank for referencing. Since the binding interaction was measured with monovalent one-armed IgGs from supernatant without purification and biochemical characterization, only the off-rates of the protein:protein interaction was used for further conclusions. Off-rates were calculated using a simple one-to-one Langmuir binding model in ProteOn Manager v3.1 software by fitting the dissociation sensorgrams. The dissociation rate constants ($k_{off}$) values of all clones are summarized in Table 3. Comparison of the produced variants revealed $k_{off}$ values with an up to 30-fold decrease compared to the parental sequence.

TABLE 3

Summary of all expressed monovalent anti-CD28 variants with dissociation rate constants ($k_{off}$) values

| Binder variants | Tapir ID | SEQ ID NO: | SEQ ID NO: | SEQ ID NO: | $k_{off}$ ($10^{-4}$/M) |
|---|---|---|---|---|---|
| CD28(SA)_variant_1 (parental CD28) | P1AE4441 | 112 | 65 | 126 | 3.0 |
| CD28(SA)_variant_2 | P1AE3058 | 113 | 120 | 126 | N/A |
| CD28(SA)_variant_3 | P1AE3059 | 113 | 121 | 126 | N/A |
| CD28(SA)_variant_4 | P1AE3060 | 113 | 122 | 126 | N/A |
| CD28(SA)_variant_5 | P1AE3061 | 113 | 65 | 126 | N/A |
| CD28(SA)_variant_6 | P1AE3062 | 114 | 120 | 126 | N/A |
| CD28(SA)_variant_7 | P1AE3063 | 114 | 121 | 126 | 100 |
| CD28(SA)_variant_8 | P1AE3064 | 114 | 122 | 126 | 68 |
| CD28(SA)_variant_9 | P1AE3065 | 114 | 123 | 126 | 78 |
| CD28(SA)_variant_10 | P1AE3066 | 114 | 124 | 126 | N/A |
| CD28(SA)_variant_11 | P1AE3067 | 114 | 65 | 126 | 37 |
| CD28(SA)_variant_12 | P1AE3068 | 115 | 125 | 126 | 2.4 |
| CD28(SA)_variant_13 | P1AE3069 | 115 | 65 | 126 | 1.9 |
| CD28(SA)_variant_14 | P1AE3070 | 116 | 120 | 126 | 100 |
| CD28(SA)_variant_15 | P1AE3071 | 116 | 121 | 126 | 24 |
| CD28(SA)_variant_16 | P1AE3072 | 116 | 122 | 126 | 10 |
| CD28(SA)_variant_17 | P1AE3073 | 116 | 123 | 126 | 14 |
| CD28(SA)_variant_18 | P1AE3074 | 116 | 124 | 126 | 82 |
| CD28(SA)_variant_19 | P1AE3075 | 116 | 65 | 126 | 2.9 |
| CD28(SA)_variant_20 | P1AE3076 | 117 | 120 | 126 | N/A |
| CD28(SA)_variant_21 | P1AE3077 | 117 | 121 | 126 | N/A |
| CD28(SA)_variant_22 | P1AE3078 | 117 | 122 | 126 | 61 |
| CD28(SA)_variant_23 | P1AE3079 | 117 | 65 | 126 | 43 |
| CD28(SA)_variant_24 | P1AE3080 | 118 | 120 | 126 | 80 |
| CD28(SA)_variant_25 | P1AE3081 | 118 | 121 | 126 | 3.51 |
| CD28(SA)_variant_26 | P1AE3082 | 118 | 122 | 126 | 9.7 |
| CD28(SA)_variant_27 | P1AE3083 | 118 | 123 | 126 | 14 |
| CD28(SA)_variant_28 | P1AE3084 | 118 | 124 | 126 | 69 |
| CD28(SA)_variant_29 | P1AE3085 | 118 | 65 | 126 | 2.5 |
| CD28(SA)_variant_30 | P1AE3086 | 119 | 125 | 126 | 3.22 |
| CD28(SA)_variant_31 | P1AE3087 | 119 | 65 | 126 | 2.5 |

Binding to human CD28 was tested with CHO cells expressing human CD28 (parental cell line CHO-kl ATCC #CCL-61. This binding assay is described in Example 4 below. The monovalent one-armed IgG-like CD28 variant constructs showed differences in binding as can be seen from FIGS. 4A to 4C.

3.3 Preparation and Kinetic Analysis of Bispecific FAP-Targeted Anti-CD28 Affinity Variants Based on the off-rate analysis and the binding study on CD28-expressing cells, several combinations of anti-CD28 VH and VL variants with different binding intensities were selected and expressed as FAP-targeted bispecific huIgG1 PG-LALA CrossFab molecules (for combinations of SEQ ID NO:s see Table 4). The resulting constructs in 1+1 format (FIG. 4B) were purified and a biochemical analysis was performed (Table 5).

TABLE 4

Summary of all expressed 1 + 1 bispecific FAP-targeted anti-CD28 variants

| Binder variants | Tapir ID | SEQ ID NO: | SEQ ID NO: | SEQ ID NO: | SEQ ID NO: |
|---|---|---|---|---|---|
| FAP (4B9) – CD28 (CD28(SA)_Variant 8) 1 + 1 | P1AE3131 | 67 | 68 | 114 | 122 |
| FAP (4B9) – CD28 (CD28(SA)_Variant 11) 1 + 1 | P1AE3132 | 67 | 68 | 114 | 65 |
| FAP (4B9) – CD28 (CD28(SA)_Variant 12) 1 + 1 | P1AE3133 | 67 | 68 | 115 | 125 |
| FAP (4B9) – CD28 (CD28(SA) Variant 15) 1 + 1 | P1AE3134 | 67 | 68 | 116 | 121 |
| FAP (4B9) – CD28 (CD28(SA)_Variant 16) 1 + 1 | P1AE3135 | 67 | 68 | 116 | 122 |
| FAP (4B9) – CD28 (CD28(SA)_Variant 17) 1 + 1 | P1AE3136 | 67 | 68 | 116 | 123 |
| FAP (4B9) – CD28 (CD28(SA)_Variant 19) 1 + 1 | P1AE3137 | 67 | 68 | 116 | 65 |
| FAP (4B9) – CD28 (CD28(SA)_Variant 23) 1 + 1 | P1AE3138 | 67 | 68 | 117 | 65 |
| FAP (4B9) – CD28 (CD28(SA)_Variant 25) 1 + 1 | P1AE3139 | 67 | 68 | 118 | 121 |
| FAP (4B9) – CD28 (CD28(SA)_Variant 27) 1 + 1 | P1AE3140 | 67 | 68 | 118 | 123 |
| FAP (4B9) – CD28 (CD28(SA)_Variant 29) 1 + 1 | P1AE3141 | 67 | 68 | 118 | 65 |

TABLE 5

Summary of the production and purification of FAP-targeted anti-CD28 variants

| TaPIR ID | Bispecific molecules | Yield [mg/l] | Analytical SEC (HMW/ Monomer/ LMW) [%] | Purity measured by CE-SDS [%] |
|---|---|---|---|---|
| P1AE3131 | FAP (4B9)-CD28 (CD28(SA)_Variant 8) 1 + 1 | 11.8 | 0.1/98.5/1.4 | 100 |
| P1AE3132 | FAP (4B9)-CD28 (CD28(SA)_Variant 11) 1 + 1 | 8.1 | 0.5/97.4/2.1 | 100 |
| P1AE3133 | FAP (4B9)-CD28 (CD28(SA)_Variant 12) 1 + 1 | 6.1 | 0/100/0' | 100 |
| P1AE3134 | FAP (4B9)-CD28 (CD28(SA)_Variant 15) 1 + 1 | 9.2 | 0/100/0 | 100 |
| P1AE3135 | FAP (4B9)-CD28 (CD28(SA)_Variant 16) 1 + 1 | 0.4 | 0/100/0 | 97 |
| P1AE3136 | FAP (4B9)-CD28 (CD28(SA)_Variant 17) 1 + 1 | 1.35 | 0/78.7/21.3 | 87 |
| P1AE3137 | FAP (4B9)-CD28 (CD28(SA)_Variant 19) 1 + 1 | 2.6 | 0/100/0 | 100 |
| P1AE3138 | FAP (4B9)-CD28 (CD28(SA)_Variant 23) 1 + 1 | 15.5 | 0/97.5/2.5 | 98 |
| P1AE3139 | FAP (4B9)-CD28 (CD28(SA)_Variant 25) 1 + 1 | 5.4 | 0/88.7/11.3 | 100 |
| P1AE3140 | FAP (4B9)-CD28 (CD28(SA)_Variant 27) 1 + 1 | 9.7 | 0/98.3/1.7 | 96 |
| P1AE3141 | FAP (4B9)-CD28 (CD28(SA)_Variant 29) 1 + 1 | 1.76 | 1/99/0 | 96.3 |

Affinity ($K_D$) of the produced bispecific antigen binding molecules to CD28 was measured by SPR using a ProteOn XPR36 instrument (Biorad) at 25° C. with biotinylated huCD28-Fc antigen immobilized on NLC chips by neutravidin capture. Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of about 200, 400 or 800 response units (RU) in vertical orientation. Injection of analytes: For one-shot kinetics measurements, injection direction was changed to horizontal orientation, two-fold dilution series of purified bispecific FAP-targeted anti-CD28 affinity variants (varying concentration ranges between 50 and 3A25 nM) were injected simultaneously at 50 µl/min along separate channels 1-5, with association times of 150s, and dissociation times of 450s. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant ($K_D$) was calculated as the ratio $k_{off}/k_{on}$. Analyzed clones revealed $K_D$ values in a broad range (between 1 and 25 nM). The kinetic and thermodynamic data are summarized in Table 6.

TABLE 6 kinetic and thermodynamic analysis of expressed FAP-targeted anti-CD28 variants

| Bispecific molecule | $k_{on}$ (1/s*M) | $k_{off}$ (1/s) | $K_D$ (nM) |
|---|---|---|---|
| parental | 3.79 exp5 | 3.6 exp-4 | 1 |
| FAP (4B9)-CD28 (CD28(SA)_Variant 8) 1 + 1 | 2.19 exp5 | 5.21 exp-3 | 23.8 |
| FAP (4B9)-CD28 (CD28(SA)_Variant 11) 1 + 1 | 2.3 exp5 | 2.87 exp-3 | 12.5 |
| FAP (4B9)-CD28 (CD28(SA)_Variant 12) 1 + 1 | 2.61exp5 | 2.67 exp-4 | 1 |
| FAP (4B9)-CD28 (CD28(SA)_Variant 15) 1 + 1 | 2.59 exp5 | 1.84 exp-3 | 7.1 |
| FAP (4B9)-CD28 (CD28(SA)_Variant 16) 1 + 1 | 1.87 exp5 | 9.94 exp-4 | 5.3 |
| FAP (4B9)-CD28 (CD28(SA)_Variant 17) 1 + 1 | 3.38 exp5 | 1.25 exp-3 | 3.7 |
| FAP (4B9)-CD28 (CD28(SA)_Variant 19) 1 + 1 | 2.8 exp5 | 3.04 exp-4 | 1.1 |
| FAP (4B9)-CD28 (CD28(SA)_Variant 23) 1 + 1 | 2.11 exp5 | 3.42 exp-3 | 16.3 |
| FAP (4B9)-CD28 (CD28(SA)_Variant 25) 1 + 1 | 2.38 exp5 | 3.96 exp-4 | 1.7 |
| FAP (4B9)-CD28 (CD28(SA)_Variant 27) 1 + 1 | 2.27 exp5 | 1.21 exp-3 | 5.4 |
| FAP (4B9)-CD28 (CD28(SA)_Variant 29) 1 + 1 | 2.72 exp5 | 3.07 exp-4 | 1.1 |

Example 4

Binding of Monovalent CD28 Agonistic IgGs and FAP-Targeted CD28 Agonistic Antibodies to CD28-Expressing and FAP-Expressing Cells Binding to human CD28 was tested with CHO cells expressing human CD28 (parental cell line CHO-kl ATCC #CCL-61, modified to stably overexpress human CD28). To assess binding, cells were harvested, counted, checked for viability and re-suspended at $2.5 \times 10^5$/ml in FACS buffer (eBioscience, Cat No 00-4222-26). $5 \times 10^4$ cells were incubated in round-bottom 96-well plates for 2 h at 4° C. with increasing concentrations of the CD28 binders (1 pM-100 nM). Then, cells were washed three times with cold FACS buffer, incubated for further 60 min at 4° C. with PE-conjugated, goat-anti human PE (Jackson ImmunoReserach, Cat No 109-116-098), washed once with cold FACS buffer, centrifuged and resuspended in 100 ul FACS buffer. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism6.

The monovalent one-armed IgG-like CD28 variant constructs showed differences in binding as can be seen from FIGS. 4A to 4C. Furthermore, the binding of bispecific FAP-targeted anti-CD28 antibodies in 1+1 format to CHO cells expressing human CD28 was determined. The $K_D$ values for the different 1+1 constructs with selected CD28 variants are shown in Table 7 below or in the corresponding graphs of FIGS. 4D and 4E.

TABLE 7

Binding of FAP-targeted anti-CD28 1 + 1 constructs to CHO cells expressing human CD28

| Binder | TAPIR | $K_D$ (nM) |
|---|---|---|
| TGN1412 | P1AD4492 | 1 |
| variant 8 | P1AE3131 | 23.8 |
| variant 11 | P1AE3132 | 12.5 |
| variant 12 | P1AE3133 | 1 |
| variant 15 | P1AE3134 | 7.1 |
| variant 16 | P1AE3135 | 5.3 |
| variant 17 | P1AE3136 | 3.7 |
| variant 19 | P1AE3137 | 1.1 |
| variant 23 | P1AE3138 | 16.3 |
| variant 25 | P1AE3139 | 1.7 |
| variant 27 | P1AE3140 | 5.4 |
| variant 29 | P1AE3141 | 1.1 |

The binding of bispecific FAP-targeted anti-CD28 antibodies in 1+1 format to FAP-expressing 3T3-huFAP cells (clone 19) was also determined as described in Example 2.1 and is shown in the corresponding graphs of FIGS. 4F and 4G.

Example 5

Binding of CEA-Targeted CD28 Agonistic Antibodies to CD28-Expressing Cells

Binding to human CD28 was tested with CHO cells expressing human CD28 (Binding was assessed by flow cytometry with a FACS Fortessa (BD, Software FACS Diva) as described in Example 4. Binding curves were obtained using GraphPadPrism6. The binding curves for the different 1+1 constructs with selected CD28 variants are shown in FIG. 16.

Example 6

In Vitro Functional Characterization of Targeting CD28 and Fibroblast Activation Protein (FAP) or Carcinoembryonic Antigen (CEA)

Several cell-based in vitro assays were performed with primary human PBMCs to evaluate the activity of CD28 (SA) and bispecific FAP-targeted CD28 antigen binding molecules in the presence and absence of TCR signals provided by T-cell bispecific-(TCB) antibodies. T-cell proliferation, cytokine secretion, and tumor cell killing as determined by flow cytometry, cytokine ELISA, and live cell imaging were obtained as read-outs.

1. The activity of the original superagonistic CD28(SA) IgG4 was assessed using a previously described high density pre-culture system to restore the responsiveness of peripheral blood derived T cells towards CD28-mediated superagonism (Römer et al., 2011).
2. The functionality of targeted CD28 molecules in absence of TCR signals was assessed in a primary human PBMC co-culture assay, wherein FAP- or CEA-targeted CD28 molecules were crosslinked by simultaneous binding to human CD28 on T cells and human FAP, expressed on either 3T3-huFAP cells (parental cell line ATCC #CCL-92, modified to stably overexpress human FAP) or MCSP- and FAP-expressing MV3 melanoma cells, or CEA-expressing MKN45 gastric cancer cells, respectively.
3. The functionality of FAP-targeted CD28 molecules in presence of TCR signals was assessed as described above, with the additional presence of a TCB molecule, crosslinked by simultaneous binding to CD3 on T cells and, either human CEA on MKN45 gastric cancer cells, Lovo colon cancer cells, HT-29 colon cancer cells, or MCSP, expressed on MV3 melanoma cells.

PBMC Isolation

Peripheral blood mononuclear cells (PBMCs) were prepared by density gradient centrifugation from enriched lymphocyte preparations of heparinized blood obtained from a Buffy Coat (Blutspende Zurich). 25 ml of blood (diluted 1:2 in PBS) were layered over 15 ml lymphoprep (STEMCELL technologies, Cat No 07851) and centrifuged at room temperature for 25 min at 845×g without brake. The PBMC-containing interphase was collected in 50 ml tubes with a 10 ml pipette. The cells were washed with PBS and centrifuged 5 min at 611×g. The supernatant was discarded, the pellet re-suspended in 50 ml PBS and centrifuged for 5 min at 304×g. The washing step was repeated, centrifuging at 171×g. The cells were re-suspended in RPMI 1640 Glutamax (containing 5% human serum, sodium pyruvate, NEAA, 50 µM 2-mercaptoethanol, Penicillin/Streptomycin) and processed for further functional analysis according to the respective assay protocol.

High Density Pre-Culture of PBMCs and In Vitro Assessment of T Cell Activation by the CD28 Superagonist CD28 (SA)

To restore the responsiveness of human T cells to TGN1412-mediated CD28 superagonism, PBMCs were pre-cultured at high density (HD) (Römer et al, 2011) before assessing the effects of CD28 superagonistic antibodies. In brief, PBMCs were adjusted to 1E7 cells/ml in complete medium (RPMI 1640 Glutamax, 5% human serum, Sodium-Pyruvate, NEAA, 50 uM 2-Mercaptoethanol, Penicillin/Streptomycin) and cultured at 1.5 ml/well in a 24-well plate for 48 hours at 37° C., 5% $CO_2$. Cells were then re-harvested, washed in complete medium, centrifuged at 550×g for 5 min and adjusted with to the desired cell density required for functional characterization. To assess T cell proliferation, PBMCs were labelled with CFSE and CFSE-dilution was measured as proxy for T cell proliferation after 5 days of stimulation. In brief, cells were adjusted to $2 \times 10^7$/ml in PBS and labelled with 2.5 µM CFSE proliferation dye (LifeTechnologies, Cat No 65-0850-84) for 6 minutes at 37° C., 5% $CO_2$. Cells were washed once in complete medium, followed by 2 washing steps in PBS. For stimulation with TGN1412, PBMCs were adjusted to $2 \times 10^6$/ml in complete medium and $1 \times 10^5$ cells were distributed to each well of a flat bottom 96-well plate and stimulated with increasing concentrations of TGN1412 (0.0002 nM to 10 nM, triplicates). CFSE-dilution was assessed by flow cytometry. Briefly, cells were centrifuged at 550×g for 5 min and washed with PBS. CFSE-dilution was assessed by flow cytometry. Briefly, cells were centrifuged at 550×g for 5 min and washed with PBS. Surface staining for CD8 (BV711 anti-human CD8a, BioLegend #301044), CD4 (PE-Cy7 anti-human CD4, BioLegend #344612) was performed according to the suppliers' indications. Cells were then washed twice with 150 µl/well PBS and resuspended in 200 µl/well FACS buffer and analyzed using BD FACS Fortessa. Cytokine secretion was measured at day 5 post activation via cytokine ELISA (huTNFα, DuoSet #DY210-05 and huIFNγ, DuoSet #DY285-05) or cytokine multiplex (Human Cytokine 17-plex assay, Bio-Rad #M5000031YV) analysis from culture supernatants.

In Vitro Assessment of T Cell Proliferation and Cytokine Secretion by Bispecific FAP-Targeted CD28 Antigen Binding Molecules in Absence and Presence of TCB Signals Pan T cells were used as effector cells and isolated from PBMCs by MACS, using the Pan T Cell Isolation Kit (Miltenyi Biotec) according to the manufacturer's instructions.

To measure T cell activation by bispecific FAP-CD28 antigen binding molecules in absence of TCB, CFSE-labelled pan T cells were co-cultured with $3 \times 10^4$/well 3T3-huFAP or parental 3T3 cells lacking FAP expression (3T3-WT), seeded the previous day in flat-bottom 96-well plates. Bispecific FAP-CD28 antigen binding molecules were added in increasing concentrations (0.0002 nM-10 nM, triplicates).

To measure T cell proliferation in presence of a TCB signal, CFSE-labelled pan T cells were incubated with $3 \times 10^4$ FAP- and MCSP-expressing MV3 cells/well, seeded the previous day in flat-bottom 96-well plates, increasing concentrations of bispecific FAP-CD28 antigen binding molecules (0.0002 nM-10 nM, triplicates), and fixed concentration of MCSP-TCB (5 pM, P1AD2189). As controls, wells containing only TCB were included.

CFSE-dilution was assessed by flow cytometry and cytokine secretion was measured at 5 days post activation via cytokine ELISA (huTNFα, DuoSet #DY210-05 and huIFNγ, DuoSet #DY285-05) or cytokine multiplex (Human Cytokine 17-plex assay, Bio-Rad #M5000031YV) analysis from culture supernatants.

The preparation of the anti-MCSP/anti-CD3 bispecific antibody (MCSP-TCB) used in the experiment is described in WO 2014/131712 A1.

Superagonism of CD28(SA) Requires FcγRIIb Cross-Linking

High Density Pre-Culture of PBMCs Restores CD28(SA) Superagonism

To understand the mechanism of action of CD28(SA), we validated high density (HD) pre-culture of PBMCs as a previously described protocol to restore the ability of PBMC-derived T cells to respond to TGN1412-mediated CD28 superagonism (Römer et al., 2011). As depicted in FIGS. 5A and 5B, CD28(SA) IgG4 (P1AE1975) induces PBMC T cell proliferation (FIG. 5A) and cytokine production (FIG. 5B) in a concentration-dependent manner at 5 days post stimulation only in PBMCs subjected to HD pre-culture, while fresh PBMCs remained unresponsive. We concluded that the previously published protocol to restore T cells' responsiveness to CD28(SA) in vitro (Römer et al., 2011) could be reproduced in our hands.

CD28(SA) Superagonistic Activity Requires Cross-Linking Via FcγRIIb—Blocking of FcγRIIb Abolishes CD28 (SA) Functionality Previously published literature indicates that TGN1412 potentially relies on FcγRIIb cross-linking. To understand the link between HD pre-culture of PBMCs and Fc-dependence of CD28(SA) functionality, the expression levels of FcγRIIb on PBMCs were assessed by flow cytometry before and after HD pre-culture. As depicted in FIG. 5C, FcγRIIb expression was absent in fresh PBMC monocytes, while 96.8% of monocytes expressed FcγRIIb after 2 days of HD pre-culture. Antibody-mediated blocking of FcγRIIb in subsequent T cell proliferation assays completely abrogated T cell proliferation upon stimulation with CD28(SA), measured after 5 days in culture (FIG. 5D). In an alternative approach, an Fc-silenced variant of CD28(SA) which carries the P329G-LALA mutation (CD28(SA) IgG1 PG-LALA: P1AD9289) did not display superagonistic function (FIG. 6A). These data confirm that CD28(SA)-mediated CD28 superagonism relies on cross-linking via FcγRIIb.

Adding a Tumor-Targeting Moiety for FAP-Targeting to Fc-Silent CD28(SA) Restores Superagonism, which is then Dependent on the Presence of the Tumor Target Given that CD28 superagonism by TGN1412 relies on FcγRIIb cross-linking, we hypothesized that FcR-dependence may be re-directed to tumors by introduction of (i) an Fc-silencing P329G-LALA mutation and (ii) a targeting moiety that cross-links to a surface-expressed tumor-antigen. To test this hypothesis, a FAP-targeting moiety was added as C-terminal fusion to an Fc-silenced TGN1412 (FAP-CD28 1+2 SA: P1AD9011). Since FcR-crosslinking was not required for this approach, PBMCs were not subjected to HD pre-culture. Instead, fresh PBMCs were co-cultured with 3T3-huFAP or 3T3-WT for 5 days in presence of increasing concentration of FAP-CD28 (P1AD9011) and T cell proliferation was assessed by CFSE-dilution via flow cytometry. As shown in FIG. 6B, the introduction of FAP-binding moiety enabled T cell proliferation exclusively in the presence of FAP. We concluded that superagonism can be selectively targeted to tumor antigens by Fc-silencing and addition of a tumor-targeting moiety.

Conventional CD28 Agonistic Antibodies (Clone 9.3) do not Behave Superagonistically in Tumor-Targeted Bispecific Formats Two types of CD28 agonistic antibodies have been reported in the literature: superagonistic CD28 antibodies such as TGN1412 are able to autonomously activate T cells without the necessity of an additional signal provided by TCR. These antibodies are referred to as superagonists, because they surpass the functionality of natural CD28 agonistic ligands CD80 and CD86, which strictly rely on the presence of a TCR signal to enhance T cell function. In contrast to superagonistic antibodies such as TGN1412, conventional agonistic antibodies such as clone mab 9.3 are not able to activate T cells autonomously, but, just like the natural CD28 ligands, require an additional TCR signal to enhance T cell activity. To assess the effect of targeting CD28 agonists to tumor antigens in more detail, we generated further FAP-CD28 molecules: (i) a superagonistic (SA) molecule with 2 CD28 binding moieties (TGN1412) and 2 FAP binding moieties=2+2 SA format (P1AD4493), (ii) a conventional agonist (CA) with 2 CD28 binding moieties (clone 9.3) and 1 or 2 FAP binding moieties, respectively: 2+2 CA (P1AD8968), 1+2 CA (P1AD8962). Fresh PBMCs were co-cultured with 3T3-huFAP or 3T3-WT for 5 days in presence of increasing concentration of the FAP-targeted molecules and T cell proliferation was assessed by CFSE-dilution via flow cytometry. As depicted in FIGS. 7A to 7D, only superagonistic binders were able to activate T cells. Further, T cell activation via the described superagonistic constructs is strictly dependent on the presence of FAP (FIG. 7B), as demonstrated by absent T cell activation in absence of FAP (FIG. 7D). In line with these data, also cytokine secretion was only observed for constructs harboring the superagonistic CD28(SA) antibodies, but not the conventional agonistic 9.3 antibody (FIG. 7E). We concluded that only superagonistic CD28 antibodies elicit autonomous T cell activation in bispecific tumor-targeted antibody formats, while the same formats with conventional 9.3 binders are not superagonistic.

Example 7

In Vitro Assessment of Tumor Cell Killing by Tumor-Targeted CD28 Molecules in the Absence or Presence of TCB To assess the ability of bispecific FAP-CD28 or CEA-CD28 antigen binding molecules to achieve tumor cell killing or support TCB-mediated tumor cell killing, purified pan T cells served as effector cells and RFP-expressing MV3 cells and MKN45 cells, respectively, served as tumor targets.

To assess killing of MV3 tumor cells, 5000 MV3 target cells seeded the previous day were co-cultured with $1 \times 10^5$ pan T cells per well in flat bottom 96-well plates (E:T 20:1), in presence of 5 pM MCSP-TCB (P1AD2189) alone or in combination with 10 nM bispecific FAP-CD28 antigen binding molecule. To assess killing of MV3 tumor cells, 5000 MV3 target cells seeded the previous day were co-cultured with $1 \times 10^5$ pan T cells per well in flat bottom 96-well plates (E:T 20:1), in presence of 2 nM FAP-CD28. To assess the killing of MKN45 tumor cells, 5000 MKN45, seeded the previous day, were co-cultured with $1 \times 10^5$ pan T cells per well in flat-bottom 96-well plates in presence of 2 nM CEA-CD28. Killing of target cells was monitored over the course of 90 hours, using the IncuCyte live cell imaging system (Essen Biosciences), capturing 4 images per well every 3 hours. RFP+ object counts per image (assessed via IncuCyte ZOOM software, Essen Biosciences) over time served as proxy for target cell death. Antibody-mediated target cell killing was distinguished from spontaneous target cell death by monitoring counts of target cells in presence of effector T cells alone over time (=baseline control). Killing was calculated as 100−x, x being % targets relative to the baseline control. Statistical analyses were performed using student's t-test, comparing the areas under the curves (AUC) of % killing over time.

FAP-CD28 Induces Target Cell Killing in the 1+2 Format, but Only with Superagonistic CD28 Binders, not with Conventional CD28 Agonistic Binders The ability of FAP-CD28 molecules to induce tumor cell killing was assessed. As depicted in FIGS. 8A to 8D, co-culture of PBMC-derived T cells with FAP-expressing MV3 melanoma cells in presence of FAP-CD28 over 90 hours led to killing of MV3 cells exclusively by FAP CD28(SA) in 1+2 format (P1AD9011) and was comparable to the induction of killing achieved by a FAP-targeted TCB (7). No killing was observed with FAP-CD28(SA) in 2+2 format (P1AD4493) as well as FAP-CD28 with conventional CD28 agonistic 9.3 antibody (P1AD8968 & P1AD8962). We conclude that in addition to T cell proliferation and cytokine secretion, a FAP-CD28 in 1+2 format with superagonistic binders can also elicit target cell killing, comparable to a TCB.

CEA-CD28 Induces Target Cell Killing in the 1+2 and 2+2 Format, but Only with Superagonistic Antibodies, not with Conventional CD28 Agonistic Antibodies In an alternative approach, we used CEA-targeted CD28 agonistic molecules in the 2+2 SA (P1AE1195), 1+2 SA (P1AE1194), 2+2 CA (P1AE1193), and 2+1 CA (P1AE1192) formats to assess their ability to induce target cell killing. PBMC T cells were co-cultured with CEA-expressing MKN45 cells in presence of CEA-CD28 in the aforementioned formats for 90 h. Both formats containing superagonistic CD28 binders were able to induce killing of CEA-expressing MKN45 cells (FIGS. 9A and 9B). We speculate that the discrepancy between FAP-CD28(SA) 2+2 and CEA-CD28 (SA) 2+2's ability to kill their respective target cells lies within discrepancies of target expression levels in MKN45 vs. MV3 cells. Precisely, in house data confirmed that FAP-expression levels of MV3 cells are 10x lower than CEA-expression levels of MKN45 cells. Thus, in MV3 cells, tumor target binding sites might be limiting and killing of MV3 cells requires efficient occupancy of FAP vs. CD28, which is advantageous in the 1+2 format (i.e. 1 FAP binding site cross-links 2 CD28 binding sites) compared to the 2+2 (i.e. 2 FAP binding sites required for cross-linking of 2 CD28 binding sites).

CD28 Superagonism by TGN1412 Binders Relies on CD28 Binder Multivalency—Monovalent Binders are not Superagonistic To further investigate the nature of CD28 superagonism, we assessed if monovalent CD28 TGN1412 binders display superagonistic behavior in a tumor-targeted bispecific format. PBMC T cells were co-cultured with 3T3-huFAP cells and incubated with increasing concentrations FAP-CD28 1+2 SA with CD28 bivalency (P1AD9011) and FAP-CD28 1+1 SA with CD28 monovalency (P1AD4492). As displayed in FIG. 10A, FAP-CD28 with monovalent CD28 binding (P1AD4492) was not able to induce T cell proliferation, as opposed to the CD28 bivalent construct (P1AD9011). Consistently, upregulation of the T cell activation markers CD69 and CD25 was only observed with the CD28 bivalency (FIGS. 10B and 10C, respectively). In conclusion, TGN1412-mediated superagonism does not only rely on cross-linking via Fc receptors but also requires CD28 binder multivalency.

In conclusion, it could be established that CD28 superagonism can be targeted specifically to tumor antigens by Fc-silencing and introduction of an antigen binding domain capable of specific binding to a tumor-associated antigen. Further, tumor-targeted bispecific antibodies are only superagonistic when they comprised CD28(SA)-based binders and not when they comprised conventional agonistic binders (clone 9.3). Further, superagonism requires multivalency of the CD28(SA) binder and monovalent CD28(SA) binding in bispecific constructs abrogates superagonistic T cell activation.

FAP-CD28 Supports TCB-Mediated Target Cell Killing and Requires CD28 Binder Monovalency to Sustain Tumor Target Dependence CD28 signaling is well described to enhance T cell receptor mediated T cell responses. Therefore, T cell bispecific antibodies (TCBs) are a promising combination partner for CD28 agonism. Through combination of targeted CD28 agonism with TCBs, we envision to enhance TCB-mediated effector functions, lower the threshold of CEA-expression for efficient TCB-mediated T cell activation, provide survival cues and support resistance towards T cell suppression via PD-1 and CTLA4.

To investigate if targeted CD28 agonists can enhance TCBs, we assessed the ability of FAP-CD28(SA) 1+2 (P1AD9011) and FAP-CD28(SA) 1+1 (P1AD4492) to support TCB-mediated target cell killing. Co-culture of PBMC-derived T cells with MCSP- and FAP co-expressing MV3 cells for 5 days in the presence of increasing concentrations of FAP-CD28 and fixed, limiting concentration of MCSP-TCB (5 pM) led to increased killing of MV3 target cells in a FAP-CD28 concentration-dependent manner (FIG. 11A). However, the presence of the TCB abolished FAP-dependence of FAP-CD28 in the CD28 bivalent format (P1AD9011), while FAP-dependence was maintained in the CD8 monovalent format (P1AD4492), as demonstrated by a concentration-dependent increase in CEACAM5-TCB-mediated target cell killing in presence of CEA-expressing, FAP-negative MKN45 tumor cells at 5 days post stimulation (FIG. 11B).

In an alternative approach, we assessed T cell proliferation induced by FAP-CD28 1+2 SA (P1AD9011) in presence or absence of TCB and in presence or absence of FAP, respectively. As shown in FIG. 12A and in the previous example, FAP-CD28(SA) 2+1 is strictly dependent on the presence of FAP for T cell activation in absence of TCBs. In presence of TCBs, however, as shown in FIG. 12B, FAP-CD28(SA) 1+2 induces enhancement of T cell activation even in absence of FAP.

We hypothesize that the TCB-induced TCR signal potentially leads to sufficient pre-clustering of TCR signaling components, thus rendering surface cross-linking of CD28 receptors on T cells by bivalent CD28 molecules sufficient to elicit co-stimulation. We conclude that for TCB combination approaches, CD28 binder monovalency is strictly required to maintain tumor-target dependence of the targeted CD28 agonistic antigen binding molecule.

Comparison of Various Monovalent FAP-CD28 Formats Reveals a Set of Various Functional FAP-CD28 Formats, with Highest Potency for Classical 1+1 Format To assess the impact of the specific antibody format of FAP-CD28 on its ability to enhance TCB-mediated T cell activation, different formats of FAP-CD28 antigen binding molecules with monovalent CD28 binding were generated and are depicted in FIGS. 1C, 1K, 1L and 1M. FAP-CD28 1+2 with CD28 bivalency was used as a reference. To assess the functionality of these formats, PBMC T cells were incubated with MCSP- and FAP co-expressing MV3 cells for 5 days in the presence of increasing concentrations of FAP-CD28 formats together with fixed, limiting concentration of MCSP-TCB (5 pM). All formats were able to significantly increase CD8 T cell proliferation (FIG. 13A), CD4 T cell proliferation (FIG. 13B), and Target cell killing (FIG. 13C). Of note, the potency of the molecule C (P1AD4492) was highest, and comparable to the potency of the bivalent CD28 reference format 1+2 SA (P1AD9011). Binding to CD28 and FAP of all molecules is shown in FIGS. 2F and 2G, respectively.

Example 8

In Vitro Assessment of Tumor Cell Killing of the Combination of Tumor-Targeted CD28 Molecules and CEA-Targeted TCBs Preparation of T-Cell Bispecific (TCB) Antibodies TCB molecules have been prepared according to the methods described in WO 2014/131712 A1 or WO 2016/079076 A1. The preparation of the anti-CEA/anti-CD3 bispecific antibody (CEA CD3 TCB or CEA TCB) used in the experiments is described in Example 3 of WO 2014/131712 A1. CEA CD3 TCB is a "2+1 IgG CrossFab" antibody and is comprised of two different heavy chains and two different light chains. Point mutations in the CH3 domain ("knobs into holes") were introduced to promote the assembly of the two different heavy chains. Exchange of the VH and VL domains in the CD3 binding Fab were made in order to promote the correct assembly of the two different light chains. 2+1 means that the molecule has two antigen binding domains specific for CEA and one antigen binding domain specific for CD3. CEACAM5 CD3 TCB has the same format, but comprises another CEA binder and comprises point mutations in the CH and CL domains of the CD3 binder in order to support correct pairing of the light chains. CEA CD3 TCB comprises the amino acid sequences of SEQ ID NO:161, SEQ ID NO:162, SEQ ID NO:163 and SEQ ID NO:164. CEACAM5 CD TCB comprises the amino acid sequences of SEQ ID NO:165, SEQ ID NO:166, SEQ ID NO:167 and SEQ ID NO:168.

CEA-CD28 Synergizes with CEACAM5-TCB in Target Cell Killing

In an alternative approach, we generated a CEA-CD28 (SA) 1+1 bispecific antigen binding molecule (Molecule M, P1AE3127) and assessed its ability to enhance CEACAM5-TCB mediated target cell killing. To this end, CEA-expressing MKN45 colorectal cancer cells were co-cultured with PBMC T cells and CEA-CD28 (Molecule M, P1AE3127) or untargeted monovalent CD28 (Molecule L, P1AD8944) in presence or absence of suboptimal CEACAM5-TCB (10 nM) and MKN45 cell killing was assessed over time. As shown in FIG. 14, only the combination of CEACAM5-TCB and CEA-CD28 led to target cell killing, while the compounds alone did not achieve target cell killing, indicating synergistic effects. Further, untargeted CD28 in combination with CEACAM5-TCB also did not induce killing, highlighting once more the requirement of monovalent CD28 agonists for cross-linking and the thereby sustained dependence on the tumor target.

CEA-CD28 Enhances CEA-TCB and CEACAM5-TCB and Lowers CEA-Expression Thresholds on Cancer Cells for TCBs to Activate T Cells CEA-TCB and CEACAM5-TCB require a certain expression level of CEA on target cells to T cell activation and target cell killing. We assessed whether CEA-CD28 was able to lower the CEA-expression threshold for TCBs to induce efficient target cell killing. To this end, PBMC T cells were incubated with increasing concentrations of either CEA-TCB (P1AD4646) or CEACAM5-TCB (P1AD5299) and fixed concentrations of CEA-CD28 (Molecule M, P1AE3127) in presence of target cell lines with different CEA expression levels: (i) MKN45 (high expression, approx. 400 000 CEA binding sites/cell), (ii) Lovo (medium expression, approx. 60 000 CEA binding sites/cell), (iii) HT-29 (low expression, approx. 6 000 CEA binding sites/cell). T cell proliferation was measured as proxy of T cell activation. As shown in FIG. 15, CEA-CD28 could significantly increase the potency of CEA-TCB and CEACAM5-TCB. Most strikingly, while the TCBs did not achieve T cell activation on low CEA-expressing HT-29 cells alone, addition of CEA-CD28 strongly enhanced the activity of the TCB. We conclude that CEA-CD2 enhances CEA-TCB and CEACAM5-TCB and lowers CEA-expression thresholds on cancer cells for TCBs to activate T cells.

Example 9

In Vitro Functional Characterization of Affinity-Reduced Variants of CD28(SA)

For the original CD28(SA) binder (TGN1412) an affinity of $K_D=1$ nM was determined. High affinity binders like this harbor the risk to be subject to peripheral sink effects, especially if the target is highly expressed in peripheral blood, as is the case for CD28. In order to (i) reduce peripheral sink effects, and (ii) reduce the risk of peripheral T cell activation through off-tumor binding of bispecific tumor-targeted CD28 antibodies to T cells, we generated a series of 31 CD28 binders with reduced affinities by introducing point mutations in the CDRs (see Example 3). FIGS. 4A, 4B and 4C show binding to CD28 on CHO cells of the CD28 monospecific, monovalent IgGs from supernatants, confirming that addition of point mutations generated a broad range of binders with varying binding properties. Based on these data, a shortlist of 11 candidates was selected for conversion into the FAP-CD28 bispecific format (see Example 4, Table 6) for further characterization. Binding assays confirmed positive binding to FAP on cells (FIGS. 4F and 4G) as well as positive and varying binding to CD28 of the chosen variants (FIGS. 4D and 4E).

Affinity-Reduced CD28 Binder Variants are Functional In Vitro in a FAP-CD28 Bispecific Format To assess whether affinity-reduced CD28 binder variants were still functional and able to support TCB-mediated effector functions, we assessed T cell proliferation in TCB combination. To this end, PBMC T cells were co-cultured with MCSP- and FAP co-expressing MV3 cells for 5 days in the presence of increasing concentrations of FAP-CD28 and fixed, limiting concentration of MCSP-TCB (5 pM). As depicted in FIG. 4H, all variants of the CD28 binders were functional and able to increase TCB-mediated T cell proliferation in a concentration dependent manner. Of note, the lowest affinity variant 8 (P1AE3131) shows an approximate 20 fold reduction of affinity compared to the parental CD28 clone but recovers approximately 86% of its potency (FIG. 4I). In line with these findings, all variants could further enhance the TCB-mediated killing of MV3 target cells (FIG. 4J). The corresponding $EC_{50}$ values are shown in Table 8 below.

TABLE 8

TCB-mediated killing of MV3 target cells by FAP-CD28 bispecific molecules of MV3 target cells

| FAP-CD28 variant | TAPIR | $EC_{50}$ killing (nM) |
|---|---|---|
| parental | P1AD4492 | 0.98 |
| variant 8 | P1AE3131 | 2.33 |
| variant 11 | P1AE3132 | 1.73 |

TABLE 8-continued

TCB-mediated killing of MV3 target cells by FAP-CD28 bispecific molecules of MV3 target cells

| FAP-CD28 variant | TAPIR | $EC_{50}$ killing (nM) |
|---|---|---|
| variant 12 | P1AE3133 | 0.98 |
| variant 15 | P1AE3134 | 1.79 |
| variant 29 | P1AE3141 | 1.11 |

Based on these results, variants 8 (lowest affinity, 23 nM), 15 (intermediate affinity: 7.1 nM) and 29 (removed hotspots, nearly no affinity reduction, $K_D$=1.1 nM) were chosen for further characterization in vitro and testing in vivo, judged by efficacy and improved bio-distribution to the tumor.

Affinity Reduced CD28 Binder Variants are Functional In Vitro in a CEA-CD28 Bispecific Format In an alternative approach, we converted the three selected variants 8, 15 and 29 into a CEA-targeted bispecific format and assessed their ability to enhance CEACAM5-TCB mediated T cell activation and target cell killing. The binding to CD28 of these molecules is shown in FIG. 16. To assess functionality, PBMC T cells were incubated with increasing concentrations of CEACAM5-TCB and fixed concentrations of CEA-CD28 variants in presence of CEA-expressing MKN45 target cells. As depicted in FIGS. 17A, 17B and 17C, all variants were able to enhance TCB-mediated CD8 T cell proliferation after 5 days (FIG. 17A), CD4 T cell proliferation after 5 days (FIG. 17B), and target cell killing at 90 h (FIG. 17C). The corresponding $EC_{50}$ values are summarized in Table 9 below.

TABLE 9

$EC_{50}$ values of TCB-mediated CD8 and CD4 T cell proliferation and target cell killing by CEA-CD28 bispecific variants

| CEA-CD28 antibody | CD4 proliferation $EC_{50}$ [nM] | CD8 proliferation $EC_{50}$ [nM] | Killing $EC_{50}$ [nM] |
|---|---|---|---|
| Parental CD28 | 0.0013 | 0.0015 | 0.002 |
| Variant 8 | 0.0035 | 0.0033 | 0.004 |
| Variant 15 | 0.0021 | 0.0016 | 0.005 |
| Variant 29 | 0.0013 | 0.0013 | 0.004 |
| TCB alone | 0.046 | 0.038 | 0.012 |

Example 10

Generation and Production of New Anti-CEA Antibodies 10.1 Generation of Humanized Variants of Anti-CEA Antibody A5B7

10.1.1 Methodology

Anti-CEA antibody A5B7 is for example disclosed by M. J. Banfield et al, Proteins 1997, 29(2), 161-171 and its structure can be found as PDB ID:1CLO in the Protein structural database PDB (world wide web.rcsb.org, H. M. Berman et al, The Protein Data Bank, Nucleic Acids Research, 2000, 28, 235-242). This entry includes the heavy and the light chain variable domain sequence. For the identification of a suitable human acceptor framework during the humanization of the anti-CEA binder A5B7, a classical approach was taken by searching for an acceptor framework with high sequence homology, grafting of the CDRs on this framework, and evaluating which back-mutations can be envisaged. More explicitly, each amino acid difference of the identified frameworks to the parental antibody was judged for impact on the structural integrity of the binder, and back mutations towards the parental sequence were introduced whenever appropriate. The structural assessment was based on Fv region homology models of both the parental antibody and its humanized versions created with an in-house antibody structure homology modeling tool implemented using the Biovia Discovery Studio Environment, version 4.5.

10.1.2 Choice of Acceptor Framework and Adaptations Thereof

The acceptor framework was chosen as described in Table 10 below:

TABLE 10

| Acceptor framework | | |
|---|---|---|
| | Closest murine V-region germline | Choice of human acceptor V-region germline |
| A5B7 VH | mu-IGHV7-3-02 | IGHV3-23-01 or IGHV3-15-01 |
| A5B7 VL | mu-IGKV4-72-01 | IGKV3-11-01 |

Post-CDR3 framework regions were adapted from human J-element germline IGJH6 for the heavy chain, and a sequence similar to the kappa J-element IGKJ2, for the light chain.

Based on structural considerations, back mutations from the human acceptor framework to the amino acid in the parental binder were introduced at positions 93 and 94 of the heavy chain.

10.1.3 VH and VL Regions of the Resulting Humanized CEA Antibodies

The resulting VH domains of humanized CEA antibodies can be found in Table 11 below and the resulting VL domains of humanized CEA antibodies are listed in Table 12 below.

TABLE 11

Amino acid sequences of the VH domains of humanized CEA antibodies, based on human acceptor framework IGHV3-23 or IGHV3-15

| Description | Sequence | SeqID NO |
|---|---|---|
| A5B7 VH murine donor sequence | EVKLVESGGGLVQPGGSLRLSCATSGFTFTDYYMNWVRQPPGKALEWLGF IGNKANGYTTEYSASVKGRFTISRDKSQSILYLQMNTLRAEDSATYYCTR DRGLRFYFDYWGQGTTLTVSS | 178 |
| IGHV3-23-02 human | EVQLLESGGGLVQPGGSLRLSCAASGFTFSSYAMSWVRQAPGKGLEWVSA ISGSGGSTYYGDSVKGRFTISRDNSKNTLYLQMNSLRAEDTAVYYCAK | 218 |

TABLE 11-continued

Amino acid sequences of the VH domains of humanized CEA antibodies, based on human acceptor framework IGHV3-23 or IGHV3-15

| Description | Sequence | SeqID NO |
|---|---|---|
| acceptor sequence | | |
| Humanized variants | | |
| 3-23A5-1 | EVQLLESGGGLVQPGGSLRLSCAASGFTFTDYYMNWVRQAPGKGLEWVGF IGNKANGYTTEYSASVKGRFTISRDNSKNTLYLQMNSLRAEDTAVYYCAR DRGLRFYFDYWGQGTTVTVSS | 220 |
| 3-23A5-2 | EVQLLESGGGLVQPGGSLRLSCAASGFTFTDYYMNWVRQAPGKGLEWVGF IGNKANGYTTYYGDSVKGRFTISRDNSKNTLYLQMNSLRAEDTAVYYCAR DRGLRFYFDYWGQGTTVTVSS | 221 |
| 3-23A5-3 | EVQLLESGGGLVQPGGSLRLSCAASGFTFTDYYMNWVRQAPGKGLEWVGF IGNKGYTTEYSASVKGRFTISRDNSKNTLYLQMNSLRAEDTAVYYCARDR GLRFYFDYWGQGTTVTVSS | 222 |
| 3-23A5-4 | EVQLLESGGGLVQPGGSLRLSCAASGFTFTDYYMSWVRQAPGKGLEWVGF IGNKANGYTTEYSASVKGRFTISRDNSKNTLYLQMNSLRAEDTAVYYCAR DRGLRFYFDYWGQGTTVTVSS | 223 |
| 3-23A5-1A (all_backmu-tations) | EVQLLESGGGLVQPGGSLRLSCAASGFTFTDYYMNWVRQAPGKGLEWLGF IGNKANGYTTEYSASVKGRFTISRDKSKNTLYLQMNSLRAEDTATYYCTR DRGLRFYFDYWGQGTTVTVSS | 224 |
| 3-23A5-1C (A93T) | EVQLLESGGGLVQPGGSLRLSCAASGFTFTDYYMNWVRQAPGKGLEWVGF IGNKANGYTTEYSASVKGRFTISRDNSKNTLYLQMNSLRAEDTAVYYCTR DRGLRFYFDYWGQGTTVTVSS | 225 |
| 3-23A5-1D (K73) | EVQLLESGGGLVQPGGSLRLSCAASGFTFTDYYMNWVRQAPGKGLEWVGF IGNKANGYTTEYSASVKGRFTISRDKSKNTLYLQMNSLRAEDTAVYYCAR DRGLRFYFDYWGQGTTVTVSS | 226 |
| 3-23A5-1E (G54A) | EVQLLESGGGLVQPGGSLRLSCAASGFTFTDYYMNWVRQAPGKGLEWLGF IGNKANAYTTEYSASVKGRFTISRDKSKNTLYLQMNSLRAEDTATYYCTR DRGLRFYFDYWGQGTTVTVSS | 186 |
| IGHV3-15*01 human acceptor sequence | EVQLVESGGGLVKPGGSLRLSCAASGFTFSNAWMSWVRQAPGKGLEWVGR IKSKTDGGTTDYAAPVKGRFTISRDDSKNTLYLQMNSLKTEDTAVYYCTT | 219 |
| Humanized variants | | |
| 3-15A5-1 | EVQLVESGGGLVKPGGSLRLSCAASGFTFTDYYMNWVRQAPGKGLEWVGF IGNKANGYTTEYSASVKGRFTISRDDSKNTLYLQMNSLKTEDTAVYYCTR DRGLRFYFDYWGQGTTVTVSS | 227 |
| 3-15A5-2 | EVQLVESGGGLVKPGGSLRLSCAASGFTFTDYYMNWVRQAPGKGLEWVGF IGNKANGYTTEYAAPVKGRFTISRDDSKNTLYLQMNSLKTEDTAVYYCTR DRGLRFYFDYWGQGTTVTVSS | 228 |
| 3-15A5-3 | EVQLVESGGGLVKPGGSLRLSCAASGFTFTDYYMNWVRQAPGKGLEWVGF IGNKANGGTTDYAAPVKGRFTISRDDSKNTLYLQMNSLKTEDTAVYYCTR DRGLRFYFDYWGQGTTVTVSS | 229 |

For the heavy chain, the initial variant 3-23A5-1 was found suitable in binding assays (but showed slightly less binding than the parental murine antibody) and was chosen as starting point for further modifications. The variants based on IGHV3-15 showed less binding activity compared to humanized variant 3-23A5-1.

In order to restore the full binding activity of the parental chimeric antibody, variants 3-23A5-1A, 3-23A5-1C and 3-23A5-1D were created. It was also tested for variant 3-23A5-1 whether the length of CDR-H2 could be adapted to the human acceptor sequence, but this construct completely lost binding activity. Since a putative deamidation hotspot was present in CDR-H2 (Asn53-Gly54), we changed that motif to Asn53-Ala54. Another possible hotspot Asn73-Ser74 was backmutated to Lys73-Ser74. Thus, variant 3-23A5-1E was created.

TABLE 12

Amino acid sequences of the VLdomains of humanized CEA antibodies, based on human acceptor framework IGKV3-1 1.

| Description | Sequence | SeqID NO |
|---|---|---|
| A5B7 VL murine donor sequence | QTVLSQSPAILSASPGEKVTMTCRASSSVTYIHWYQQKPGSSPKSWIYAT SNLASGVPARFSGSGSGTSYSLTISRVEAEDAATYYCQHWSSKPPTFGGG TKLEIK | 179 |
| IGKV3-11 human acceptor sequence | EIVLTQSPATLSLSPGERATLSCRASQSVSSYLAWYQQKPGQAPRLLIYD ASNRATGIPARFSGSGSGTDFTLTISSLEPEDFAVYYCQQRSNWP | 230 |
| humanized variants | | |
| A5-L1 | EIVLTQSPATLSLSPGERATLSCRASSSVTYIHWYQQKPGQAPRLLIYAT SNLASGIPARFSGSGSGTDFTLTISSLEPEDFAVYYCQHWSSKPPTFGQG TKLEIK | 231 |
| A5-L2 | EIVLTQSPATLSLSPGERATLSCRASQSVSSYIHWYQQKPGQAPRLLIYA TSNLASGIPARFSGSGSGTDFTLTISSLEPEDFAVYYCQHWSSKPPTFGQ GTKLEIK | 232 |
| A5-L3 | EIVLTQSPATLSLSPGERATLSCRASSSVTYIHWYQQKPGQAPRLLIYDA SNRATGIPARFSGSGSGTDFTLTISSLEPEDFAVYYCQHWSSKPPTFGQG TKLEIK | 233 |
| A5-L4 | EIVLTQSPATLSLSPGERATLSCRASSSVTYIHWYQQKPGQAPRLLIYAT SNLASGIPARFSGSGSGTDFTLTISSLEPEDFAVYYCQQWSSKPPTFGQG TKLEIK | 234 |
| A5-L1A (all_backmutations) | QTVLTQSPATLSLSPGERATLSCRASSSVTYIHWYQQKPGSSPKSWIYAT SNLASGIPARFSGSGSGTDYTLTISSLEPEDFAVYYCQHWSSKPPTFGQG TKLEIK | 235 |
| A5-L1B (Q1T2) | QTVLTQSPATLSLSPGERATLSCRASSSVTYIHWYQQKPGQAPRLLIYAT SNLASGIPARFSGSGSGTDFTLTISSLEPEDFAVYYCQHWSSKPPTFGQG TKLEIK | 236 |
| A5-L1C (FR2) | EIVLTQSPATLSLSPGERATLSCRASSSVTYIHWYQQKPGSSPKSWIYAT SNLASGIPARFSGSGSGTDFTLTISSLEPEDFAVYYCQHWSSKPPTFGQG TKLEIK | 237 |
| A5-L1D (46, 47) | EIVLTQSPATLSLSPGERATLSCRASSSVTYIHWYQQKPGQAPRSWIYAT SNLASGIPARFSGSGSGTDFTLTISSLEPEDFAVYYCQHWSSKPPTFGQG TKLEIK | 187 |

The light chain was humanized based on the human IGKV3-11 acceptor framework. In the series A5-L1 to A5-L4, it was learned that variant A5-L1 shows good binding activity (but slightly less than the parental antibody). Partial humanization of CDR-L1 (variant A5-L2; Kabat positions 30 and 31) fully abrogates the binding. Likewise, humanization of CDR-H2 (variant A5-L3; Kabat positions 50 to 56) also fully abrogates the binding. The position 90 (variant A5-L4) shows significant contribution to the binding properties. The Histidine at this position is important for binding. Thus, variant A5-L1 was chosen for further modification.

The series A5-L1A to A5-LID addressed the question which backmutations are required to restore the full binding potential of the parental chimeric antibody. Variant A5-L1A showed that backmutations at Kabat positions 1, 2, the entire framework 2, and Kabat position 71 do not add any further binding activity. Variants A5-L1B, and A5-L1C addressed subsets of those positions and confirm that they do not alter the binding properties. Variant A5-L1D with back mutations at Kabat positions 46 and 47 showed the best binding activity.

10.1.4 Selection of Humanized A5B7 Antibodies

Based on the new humanization variants of VH and VL new CEA antibodies were expressed as huIgG1 antibodies with an effector silent Fc (P329G; L234, L235A) to abrogate binding to Fcγ receptors according to the method described in WO 2012/130831 A1 and their binding to CEA expressed on MKN45 cells was tested and compared to the respective parental murine A5B7 antibody.

TABLE 13

VH/VL combinations expressed as huIgG1_LALA_PG antibodies

|  | A5-L1A | A5-L1B | A5-L1C | A5-L1D |
|---|---|---|---|---|
| 3-23A5-1A | P1AE2164 | P1AE2165 | P1AE2166 | P1AE2167 |
| 3-23A5-1C | — | — | P1AE2176 | P1AE2177 |
| 3-23A5-1D | P1AE2179 | — | P1AE2181 | P1AE2182 |

MKN45 (DSMZ ACC 409) is a human gastric adenocarcinoma cell line expressing CEA. The cells were cultured in advanced RPMI+2% FCS+1% Glutamax. Viability of MKN-45 cells was checked and cells were re-suspended and adjusted to a density of 1 Mio cells/ml. 100 ill of this cell suspension (containing 0.1 Mio cells) were seeded into a 96 well round bottom plate. The plate was centrifuged for 4 min at 400×g and the supernatant was removed. Then 40 µl of the diluted antibodies or FACS buffer were added to the cells and incubated for 30 min at 4° C. After the incubation the cells were washed twice with 150 µl FACS buffer per well. Then 20 µl of the diluted secondary PE anti-human Fc specific secondary antibody (109-116-170, Jackson ImmunoResearch) was added to the cells. The cells were incubated for an additional 30 min at 4° C. To remove unbound antibody, the cells were washed again twice with 150 µl per well FACS buffer. To fix the cells 100 µl of FACS buffer containing 1% PFA were added to the wells. Before measuring the cells were re-suspended in 150 µl FACS buffer. The fluorescence was measured using a BD flow cytometer.

In FIG. 18 binding curves of the humanized A5B7 variants are shown. All tested binders were able to bind to MKN45 cells but binding capacity was slightly reduced compared to the parental A5B7 antibody. The clone P1AE2167 had the best binding of all tested variants and was selected for further development.

10.1.5 Determination of Affinities of Fab Fragments of Humanized Variants of Murine CEA-Antibody A5B7 to Human CEA Using Surface Plasmon Resonance (BIACORE)

The affinities of Fab fragments of the humanized variants of murine CEA antibody A5B7 to human CEA were assessed by surface plasmon resonance using a BIACORE T200 instrument. On a CM5 chip, human CEA (hu N(A2-B2)A-avi-His B) was immobilized at a 40 nM concentration by standard amine coupling on flow cell 2 for 30s to about 100RU. The Fab fragments of the humanized variants of murine CEA antibody A5B7 were subsequently injected as analytes in 3-fold dilutions ranging from 500-0.656 nM for a contact time of 120s, a dissociation time of 250 or 1000s and at a flow rate of 30 µl/min. Regeneration at the level of human CEA (hu N(A2-132)A-avi-His B) was achieved by 2 pulses of 10 mM glycine/HCl pH2.0 for 60s. Data were double-referenced against the unimmobilized flow cell 1 and a zero concentration of the analyte. The sensorgrams of the analytes were fitted to a simple 1:1 Langmuir interaction model. Affinity constants [$K_D$] for human CEA (A2 domain) are summarized in Table 14 below.

The humanized variants of the murine CEA antibody A5B7 are of lower affinities than the parental murine antibody. The Fab fragment P1AE4138, derived from P1AE2167 (heavy chain with VH variant 3-23A5-1A and Ckappa light chain with VL variant A5-L1D) was chosen as final humanized variant. Moreover, a glycine to alanine mutation at Kabat position 54 (G54A) was introduced into the VH domain in order to remove a deamidation site, leading to VL variant 3-23A5-1E. The final humanized antibody (heavy chain with VH variant 3-23A5-1E and Ckappa light chain with VL variant A5-L1D) has been named A5H1EL1D or huA5B7.

10.2 Generation of A5H1EL1D-Derived Affinity-Matured Anti-CEA Antibodies 10.2.1 Preparation, Purification and Characterization of Antigens for Phage Display Campaign The murine antibody A5B7 and its humanized derivative A5H1EL1D bind to the A2 domain of CEACAM5 (CEA) with an affinity of about 0.8 and about 2.5 nM, respectively. For the generation of affinity-matured variants of A5H1EL1D by phage display, 3 different recombinant soluble antigens were generated. Each protein contained a C-terminal avi tag for site-specific biotinylation and a his-tag for purification: The first protein consisted of the extracellular part of CEACAM1 consisting of the 4 Ig-like domains N, A1, B, A2 (NABA-avi-His, SEQ ID NO: 238, Table 15). The second protein was a chimeric protein consisting of 2 CEACAM5 and 2 CEACAM1 Ig domains. Based on the sequence of the four domains of CEACAM1, the DNA encoding the second and third domain of CEACAM1 (A1 and B domains) was replaced by the DNA encoding the A2 and B2 domains of CEACAM5 (N(A2B2)A-avi-His, SEQ ID NO:239, Table 15). The third protein was a chimeric protein consisting of 1 CEACAM5 and 3 CEACAM1 Ig domains. Based on the sequence of the four domains of CEACAM1, the DNA encoding the third domain of CEACAM1 (B domain) was replaced by the DNA encoding the B2 domain of CEACAM5 (NA(B2)A-avi-His, SEQ ID NO:240, Table 15). A schematic description of the three constructs is shown in FIGS. 19A, 19B and 19C.

TABLE 14

Affinity constants of Fab fragments representing different humanized variants of murine CEA antibody A5B7 to human CEA (A2 domain)

| Tapir ID | Name | Affinity to human N(A2-B2)A-avi-His B [M] |
|---|---|---|
| P1AE0289 | CEA (A5B7) Fab (parental murine antibody) | 5.59E−10 |
| P1AE4135 | Fab derived from P1AE2164 | 1.70E−09 |
| P1AE4136 | Fab derived from P1AE2165 | 1.25E−09 |
| P1AE4137 | Fab derived from P1AE2166 | 1.13E−08 |
| P1AE4138 | Fab derived from P1AE2167 | 1.47E−09 |
| P1AE4139 | Fab derived from P1AE2176 | 7.58E−09 |
| P1AE4140 | Fab derived from P1AE2177 | 7.62E−09 |
| P1AE4141 | Fab derived from P1AE2179 | 1.83E−09 |
| P1AE4142 | Fab derived from P1AE2181 | 2.64E−09 |
| P1AE4143 | Fab derived from P1AE2182 | 2.92E−09 |

TABLE 15

Amino acid sequences of used CEA antigens

| Antigen | Sequence | SEQ ID NO |
|---|---|---|
| NABA-avi-His | QLTTESMPFNVAEGKEVLLLVHNLPQQLFGYSWYKGERVDGNRQIVGYAIGT QQATPGPANSGRETIYPNASLLIQNVTQNDTGFYTLQVIKSDLVNEEATGQF HVYPELPKPSISSNNSNPVEDKDAMAFTCEPETQDTTYLWWINNQSLPVSPR LQLSNGNRTLTLLSVTRNDTGPYECEIQNPVSANRSDPVTLNVTYGPDTPTI SPSDTYYRPGANLSLSCYAASNPPAQYSWLINGTFQQSTQELFIPNITVNNS GSYTCHANNSVTGCNRTTVKTIIVTELSPVVAKPQIKASKTTVTGDKDSVNL TCSTNDTGISIRWFFKNQSLPSSERMKLSQGNITLSINPVKREDAGTYWCEV FNPISKNQSDPIMLNVNYNALPQENLINVDLEVLFQGPGSGLNDIFEAQKIE WHEARAHHHHHH | 238 |
| N(A2B2)A-avi-His | QLTTESMPFNVAEGKEVLLLVHNLPQQLFGYSWYKGERVDGNRQIVGYAIGT QQATPGPANSGRETIYPNASLLIQNVTQNDTGFYTLQVIKSDLVNEEATGQF HVYPELPKPFITSNNSNPVEDEDAVALTCEPEIQNTTYLWWVNNQSLPVSPR LQLSNDNRTLTLLSVTRNDVGPYECGIQNKLSVDHSDPVILNVLYGPDDPTI SPSYTYYRPGVNLSLSCHAASNPPAQYSWLIDGNIQQHTQELFISNITEKNS GLYTCQANNSASGHSRTTVKTITVSALSPVVAKPQIKASKTTVTGDKDSVNL TCSTNDTGISIRWFFKNQSLPSSERMKLSQGNITLSINPVKREDAGTYWCEV FNPISKNQSDPIMLNVNYNALPQENLINVDGSGLNDIFEAQKIEWHEARAHH HHHH | 239 |
| NA(B2)A-avi-His | QLTTESMPFNVAEGKEVLLLVHNLPQQLFGYSWYKGERVDGNRQIVGYAIGT QQATPGPANSGRETIYPNASLLIQNVTQNDTGFYTLQVIKSDLVNEEATGQF HVYPELPKPSISSNNSNPVEDKDAMAFTCEPETQDTTYLWWINNQSLPVSPR LQLSNGNRTLTLLSVTRNDTGPYECEIQNPVSANRSDPVTLNVTYGPDDPTI SPSYTYYRPGVNLSLSCHAASNPPAQYSWLIDGNIQQHTQELFISNITEKNS GLYTCQANNSASGHSRTTVKTITVSALSPVVAKPQIKASKTTVTGDKDSVNL TCSTNDTGISIRWFFKNQSLPSSERMKLSQGNITLSINPVKREDAGTYWCEV FNPISKNQSDPIMLNVNYNALPQENLINVDGSGLNDIFEAQKIEWHEARAHH HHHH | 240 |

The respective plasmids were transiently transfected into HEK 293 cells, stably expressing the EBV-derived protein EBNA (HEK EBNA). A simultaneously co-transfected plasmid encoding the biotin ligase BirA allowed avi-tag-specific biotinlylation in vivo. Proteins were purified from filtered cell culture supernatants referring to standard protocols using immobilized metal affinity chromatography (1MAC) followed by gel filtration. Monomeric protein fractions were pooled, concentrated (if required), frozen and stored at −80° C. Part of the samples were provided for subsequent protein analytics and analytical characterization e.g. by SDS-PAGE, size exclusion chromatography (SEC) or mass spectrometry.

10.2.2 Selection of Affinity Matured A5H1EL1D-Derived Antibodies

Humanization of antibody A5B7 resulted in an about 3 to 4-fold reduction of the affinity to CEA measured by SPR. While the affinity for A5B7 was about 0.8 nM, an affinity of about 2.5 nM was measured for A5H1EL1D. FACS experiments using cell lines with different CEA expression levels confirmed this finding. In order to improve the affinity of the humanized clone A5H1EL1D, 3 different affinity-maturation libraries were made and used for the selection of clones with improved affinities by phage display.

10.2.2.1 Generation of A5H1EL1D Affinity Maturation Libraries

Generation of affinity-matured A5H1EL1D-derived antibodies was carried out by phage display using standard protocols (Silacci et al, 2005). In a first step, DNA sequences encoding the VH and VL of the humanized parental clone A5H1EL1D (amino acid sequences SEQ ID Nos: 186 and 187) were cloned into a phagemid which was then used as a template for randomization. In a next step, three libraries were generated for the selection of favourable clones by phage display. Maturation libraries 1 and 2 were randomized either in CDR1 and CDR2 of the heavy chain or in CDR1 and CDR2 of the light chain. The third maturation library was randomized in the CDR3 regions of both the heavy and the light chain. The randomized positions in the respective CDR regions are shown in FIGS. 20A and 20B. For the generation of the maturation library 1, randomized in CDR1 and CDR2 of the heavy chain, two fragments were assembled by "splicing by overlapping extension" (SOE) PCR and cloned into the phage vector (FIG. 21A). The following primer combinations were used to generate the library fragments: fragment 1 (LMB3 (SEQ ID NO: 243, Table 16) and A5H1EL1D_H1_rev_TN (SEQ ID NO: 241, Table 16) and fragment 2 (A5H1EL1D_H2_for_TN (SEQ ID NO: 242, Table 7) and HCDR3-rev-constant (SEQ ID NO: 244, Table 16).

TABLE 16

Primers for A5H1EL1D affinity maturation library H1/H2

| Name | Sequence | SEQ ID NO: |
|---|---|---|
| A5H1EL1D_H1_rev_TN | CAG CCA CTC GAG GCC TTT ACC CGG TGC TTG GCG TAC CCA X17 CAT X16 X15 X14 X13 GAA X12 GAA GCC AGA AGC CGC GCA GCT GAG ACG | 241 |

TABLE 16-continued

Primers for A5H1EL1D affinity maturation library H1/H2

| Name | Sequence | SEQ ID NO: |
|---|---|---|
| | X12: 60% T; 5% A/S/G/Y/N/D/E/Q<br>X13: 50% T; 20% S; 4.3% A/G/Y/N/D/E/Q<br>X14: 50% D; 20% S; 4.3% G/Y/T/N/A/E/Q<br>X15: 60% Y; 4% G/V/H/S/E/Q/N/D/R/F<br>X16: 50% Y; 20% A; 3.75% G/V/T/H/L/I/R/F<br>X17: 50% N; 20% S; 3% D/E/Q/G/Y/V/T/H/A/L | |
| A5H1EL1D_H2_for_TN | CGC CAA GCA CCG GGT AAA GGC CTC GAG TGG CTG<br>GGT X18 ATC X19 X20 X21 X22 X23 GCG TAC ACC<br>ACG GAA TAC TCC GCC TCC<br>X18: 60% F; 10% A; 6% Y/V/L/I/G<br>X19: 50% G; 20% S; 3% A/K/T/V/N/D/E/Q/L/I<br>X20: 50% N; 20% G; 3.75% D/E/Q/S/Y/T/H/A<br>X21: 60% K; 5% A/T/Y/N/D/E/Q/R<br>X22: 60% A; 4% V/G/D/P/H/N/E/Q/L/I<br>X23: 60% N; 5% D/E/Q; 4.17% G/T/H/S/A/R | 242 |
| LMB3 long | CAG GAA ACA GCT ATG ACC ATG ATT AC | 243 |
| HCDR3-rev-constant | AAC GGT CAC CGT GGT ACC CTG GCC CCA GTA GTC<br>GAA ATA GAA GCG CAG ACC AC | 244 |

For the generation of the maturation library 2, randomized in CDR1 and 2 of the light chain, two fragments were assembled by "splicing by overlapping extension" (SOE) PCR and cloned into the phage vector (FIG. 21B). The following primer combinations were used to generate the library fragments: fragment 1 (LMB3 (SEQ ID NO: 243, Table 17) and A5H1EL1D_L1_rev_TN (SEQ ID NO: 245, Table 17) and fragment 2 (A5H1EL1D_L2_for_TN (SEQ ID NO: 246, Table 17) and HCDR3-rev-constant (SEQ ID NO: 244, Table 17).

following primer combinations were used to generate the library fragments: fragment 1 (LMB3 (SEQ ID NO:243, Table 18) and LCDR3-rev-constant (SEQ ID NO:249, Table 18) and fragment 2 (A5H1EL1D_L3_for_TN (SEQ ID NO: 247, Table 18) and A5H1EL1D_H3_rev_TN (SEQ ID NO: 248, Table 18).

TABLE 17

Primers for A5H1EL1D affinity maturation library L1/L2

| Name | Sequence | SEQ ID NO: |
|---|---|---|
| A5H1EL1D_L1_rev_TN | GGA ACG CGG GGC CTG GCC TGG TTT TTG CTG ATA<br>CCA X06 X05 X04 X03 X02 X01 GCT GGA TGC GCG<br>GCA AGA CAG GGT AGC ACG<br>X01: 50% S; 20% V; 3.33% T/A/G/N/D/E/Q/Y/H<br>X02: 50% V; 20% S; 3.33% T/A/G/N/Q/F/Y/P/H<br>X03: 50% T; 20% S; 2.72% A/G/Y/V/P/H/N/D/E/Q/R<br>X04: 60% Y; 4% F/G/A/V/T/H/S/N/Q/R<br>X05: 70% I; 30% L<br>X06: 50% H; 20% A; 3.33% R/K/G/S/T/Q/Y/N/V | 245 |
| A5H1EL1D_L2_for_TN | CAG CAA AAA CCA GGC CAG GCC CCG CGT TCC TGG<br>ATC X07 X08 X09 X10 X11 CTC GCT TCT GGT ATC<br>CCG GCA CGT TTC TCC GGC<br>X07: 60% Y; 10% F; 7.5% H/K/N/S<br>X08: 50% A; 20% D; 3.33% V/G/S/T/Y/H/N/E/Q<br>X09: 50% T; 20% A; 3.33% S/G/V/F/H/N/D/E/Q<br>X10: 60% S; 4% T/A/G/N/D/E/Q/Y/V/H<br>X11: 60% N; 4% D/E/Q/Y/K/T/H/S/A/R | 246 |
| LMB3 long | CAG GAA ACA GCT ATG ACC ATG ATT AC | 243 |
| HCDR3-rev-constant | AAC GGT CAC CGT GGT ACC CTG GCC CCA GTA GTC<br>GAA ATA GAA GCG CAG ACC AC | 244 |

For the generation of the maturation library 3, randomized in CDR3 of the light and heavy chains, two fragments were assembled by "splicing by overlapping extension" (SOE) PCR and cloned into the phage vector (FIG. 21C). The

TABLE 18

Primers for A5H1EL1D affinity maturation library L3/H3

| Name | Sequence | SEQ ID NO: |
|---|---|---|
| A5H1EL1D_L3_for_TN | GAG CCT GAA GAT TTT GCC GTA TAC TAT TGT X24 X25 X26 X27 X28 X29 X30 X31 ACT TTC GGT CAG GGC ACC AAG CTG GAA ATC<br>X24: 90% Q; 10% H<br>X25: 60% H; 5% R/K/Q/E/Y/F/N/D<br>X26: 65% W; 7% F/Y/V/L/I<br>X27: 58% S; 4% T/A/G/N/D/E/Q; 2% Y/V/P/H/L/I/R<br>X28: 58% S; 4% T/A/G/N/D/E/Q; 2% Y/V/P/H/L/I/R<br>X29: 60% K; 5% R/H; 2.72% A/V/T/P/Y/N/D/E/Q/L/I<br>X30: 70% P; 5% A/S/T/R/S/L<br>X31: 60% P; 5% L/G/R/M; 2.86% A/V/L/I/F/S/R | 247 |
| A5H1EL1D_H3_rev_TN | AAC GGT CAC CGT GGT ACC CTG GCC CCA GTA GTC X40 X39 X38 X37 X36 X35 X34 X33 X32 AGT ACA GTA GTA GGT GGC GGT GTC TTC TGC<br>X32: 60% R; 10% K; 2.72% A/V/T/P/Y/N/D/E/Q/L/H<br>X33: 60% D; 5% N/E/Q; 2.5% G/Y/V/T/H/S/A/L/I/R<br>X34: 60% R; 5% K/H; 2.72% A/V/T/P/Y/N/D/E/Q/L/I<br>X35: 60% G; 5% A/S/T; 2.5% Y/V/P/H/N/D/E/Q/L/I<br>X36: 60% L; 4% I/V/A/F; 2.4% G/Y/T/P/H/S/N/D/E/Q<br>X37: 60% R; 5% K/H; 2.72% A/V/T/P/Y/N/D/E/Q/L/I<br>X38: 65% F; 5% Y/W/A/V/L/I/G<br>X39: 60% Y; 5% F/W; 2.14% G/A/V/T/P/H/S/N/D/E/Q/L/I/R<br>X40: 80% F; 10% I/L | 248 |
| LCDR3-rev-constant | ACA ATA GTA TAC GGC AAA ATC TTC AGG CTC | 249 |
| LMB3 long | CAG GAA ACA GCT ATG ACC ATG ATT AC | 243 |
| HCDR3 amplification | AGA AAC GGT CAC CGT GGT ACC CTG GCC CCA GTA GTC | 250 |

For the assembly of the fragments of each library, equimolar amounts of each fragment were used and amplified with the respective outer primers. For the assembly of the fragments of the third library, randomized in HCDR3 and LCDR3, primer LMB3 (SEQ ID NO:243, Table 18) was used in combination with the primer "HCDR3 amplification" (SEQ ID NO:250, Table 18). This primer was used in order to extend the C-terminal end of VH with the sequence containing a KpnI site. After assembly of sufficient amounts of full length randomized fragments for all libraries, they were digested with NcoI/KpnI alongside with identically treated acceptor phagemid vector. A 3-fold molar excess of library insert was ligated with 20 μg of phagemid vector. Purified ligations were used for 20 transformations resulting in about $0.7 \times 10^9$ to $2 \times 10^9$ transformants. Phagemid particles displaying the A5H1EL1D affinity maturation libraries were rescued and purified by PEG/NaCl purification to be used for selections.

10.2.2.2 Selection of Affinity Matured A5H1EL1D-Derived Clones

For the selection of affinity-matured clones, phage display selection with all 3 libraries was performed using recombinant soluble antigens. Panning rounds were performed in solution according to the following pattern: 1. Pre-clearing of non-specific phagemid particles by incubation with 200 nM biotinylated NA(B2)A-avi-His and NABA-avi-his for 0.5 h, 2. capture of biotinylated NA(B2)A-avi-His, NABA-avi-his, and bound phagemid particles by addition of $5.4\times10^7$ streptavidin-coated magnetic beads for 10 min, 3. Isolation of non-bound phagemid particles from supernatant for further selection, 4. binding of phagemid particles to 20 nM biotinylated N(A2B2)A-avi-His for 0.5 h in a total volume of 1 ml, 5. capture of biotinylated N(A2B2)A-avi-His protein and specifically bound phage particles by addition of $5.4\times10^7$ streptavidin-coated magnetic beads for 10 min, 6. washing of beads using 5×1 ml PBS/Tween20 and 5×1 ml PBS, 7. elution of phage particles by addition of 1 ml of 100 mM TEA for 10 min and neutralization by adding 500 μl 1M Tris/HCl pH 7.4, 8. infection of exponentially growing *E. coli* TG1 bacteria, 9. infection with helperphage VCSM13, and 10. subsequent PEG/NaCl precipitation of phagemid particles to be used in subsequent selection rounds. Selections were carried out over 3 rounds using decreasing antigen concentrations ($20\times10^{-9}$M, $10\times10^{-9}$M, and $2\times10^{-9}$M). In round 3, streptavidin beads were washed with 20×1 ml PBS/Tween20 and 5×1 ml PBS.

Specific binders were identified by ELISA as follows: 100 μl of either 10 nM biotinylated N(A2B2)A-avi-His protein or 40 nM biotinylated NA(B2)A-avi-His protein per well were coated on neutravidin plates. Fab-containing bacterial supernatants were added and binding Fabs were detected via their Flag-tags using an anti-Flag/HRP secondary antibody.

Clones that were ELISA-positive on recombinant N(A2B2)A-avi-His protein but not on NA(B2)A-avi-His protein were further tested by SPR.

10.2.2.3 Identification of Affinity-Matured A5H1EL1D-Derived Variants by SPR

In order to further characterize the ELISA-positive clones, the off-rate was measured by surface plasmon resonance using a Proteon XPR36 machine and the results were compared with the parental humanized clone A5H1EL1D.

For this experiment, about 2000, 1000, and 500 RU of biotinylated N(A2B2)A-avi-His were immobilized on 3 channels using a Streptavidin-coated NLC chip in vertical orientation. As a control for non-specific binding, 2000 RU of biotinylated NA(B2)A-avi-His protein was immobilized on channel 4. For the off-rate analysis of the identified ELISA-positive clones, injection direction was changed to horizontal orientation. Before injection, each Fab-containing bacterial supernatant was filtered and 3-fold diluted with PBS. The association time was 100s at 100 µl/minute and dissociation times were either 600 or 1200s. Bacterial supernatant without Fab fragment was used for referencing. Regeneration was performed with 10 mM glycine pH 1.5 for 35s at 50 µl/min (vertical orientation).

Dissociation rate constants (koff) were calculated using a simple one-to-one Langmuir binding model in ProteOn Manager v3.1 software by simultaneously fitting the sensorgrams. Clones expressing Fabs with the slowest dissociation rate constants were identified and shortlisted. Shortlisted clones were re-evaluated in an additional SPR experiments under the same conditions. This time, during each injection, 4 affinity-matured clones were directly compared in parallel with the parental clone A5H1EL1D. Bacterial supernatant without Fab fragment was used for referencing. Clones that showed a slower dissociation rate than A5H1EL1D on N(A2B2)A-avi-His and no binding to NA(B2)A-avi-His were selected and the variable domains of the corresponding phagemids were sequenced. The measured dissociation rates of the best clones are shown in Table 19 and the sequences of the respective variable domains are listed in Table 20.

TABLE 19

Kinetic dissociation constants (koff) of selected clones obtained in screening analysis with bacterial supernatant

| clone | Dissociation constant kd (1/s) |
|---|---|
| A5H1EL1D | 3.10E-04 |
| P006.038 | 7.41E-05 |
| P005.097 | 8.87E-05 |
| P005.103 | 5.37E-05 |
| P002.139 | 6.47E-05 |
| P001.177 | 9.81E-05 |
| P005.102 | 4.24E-05 |

TABLE 20

Amino acid sequences of the parental clone A5H1EL1D and selected affinity-matured clones

| Clone | Chain | SEQ ID NO | Sequence |
|---|---|---|---|
| A5H1EL1D | VL | 187 | EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIK |
|  | VH | 186 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSS |
| P006.038 | VL | 195 | EIVLTQSPATLSLSPGERATLSCRASSSVTYIHWYQQKPGQAPRSWIYATSNLASGIPARFSGSGSGTDFTLTISSLEPEDFAVYYCQHWSSVPPTFGQGTKLEIK |
|  | VH | 194 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFGFDYWGQGTTVTVSS |
| P005.097 | VL | 197 | EIVLTQSPATLSLSPGERATLSCRASSSVTYIHWYQQKPGQAPRSWIYATSNLASGIPARFSGSGSGTDFTLTISSLEPEDFAVYYCQHWSSQPPTFGQGTKLEIK |
|  | VH | 196 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFSFDYWGQGTTVTVSS |
| P005.103 | VL | 199 | EIVLTQSPATLSLSPGERATLSCRASSSVTYIHWYQQKPGQAPRSWIYATSNLASGIPARFSGSGSGTDFTLTISSLEPEDFAVYYCQHWSSISPTFGQGTKLEIK |
|  | VH | 198 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFYFDYWGQGTTVTVSS |

TABLE 20-continued

Amino acid sequences of the parental clone A5H1EL1D and selected affinity-matured clones

| Clone | Chain | SEQ ID NO | Sequence |
|---|---|---|---|
| P002.139 | VL | 201 | EIVLTQSPATLSLSPGERATLSCHASSSVTYIHWYQQKPGQAPRSWIYATSNLASGIPARFSGSGSGTDFTLTISSLEPEDFAVYYCQHWSSKPPTFGQGTKLEIK |
|  | VH | 200 | EVQLLESGGGLVQPGGSLRLSCAASGFYFTDYAMNWVRQAPGKGLEWLGVISNKANAYTTEYSASVKGRFTISRDKSKNTLYLQMNSLRAEDTATYYCTRDRGLRFYFDYWGQGTTVTVSS |
| P001.177 | VL | 203 | EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIK |
|  | VH | 202 | EVQLLESGGGLVQPGGSLRLSCAASGFYFTDYYMNWVRQAPGKGLEWLGFISNKANAYTTEYSASVKGRFTISRDKSKNTLYLQMNSLRAEDTATYYCTRDRGLRFYFDYWGQGTTVTVSS |
| P005.102 | VL | 205 | EIVLTQSPATLSLSPGERATLSCRASSSVTYIHWYQQKPGQAPRSWIYATSNLASGIPARFSGSGSGTDFTLTISSLEPEDFAVYYCQHWSSKSPTFGQGTKLEIK |
|  | VH | 204 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFQFDYWGQGTTVTVSS |
| P005.102-combo1 | VL | 207 | EIVLTQSPATLSLSPGERATLSCRASSSVTYIHWYQQKPGQAPRSWIYATSNLASGIPARFSGSGSGTDFTLTISSLEPEDFAVYYCQHWSSKSPTFGQGTKLEIK |
|  | VH | 206 | EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFQFDYWGQGTTVTVSS |
| P005.102-combo2 | VL | 209 | EIVLTQSPATLSLSPGERATLSCRASSSVTYIHWYQQKPGQAPRSWIYATSNLASGIPARFSGSGSGTDFTLTISSLEPEDFAVYYCQHWSSKSPTFGQGTKLEIK |
|  | VH | 208 | EVQLLESGGGLVQPGGSLRLSCAASGFYFSDYYMNWVRQAPGKGLEWLGVISNKANAYTTEYSASVKGRFTISRDKSKNTLYLQMNSLRAEDTATYYCTRDRGIRFQFDYWGQGTTVTVSS |
| P005.103-combo1 | VL | 211 | EIVLTQSPATLSLSPGERATLSCRASSSVTYIHWYQQKPGQAPRSWIYATSNLASGIPARFSGSGSGTDFTLTISSLEPEDFAVYYCQHWSSISPTFGQGTKLEIK |
|  | VH | 210 | EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFSFDYWGQGTTVTVSS |
| P005.103-combo2 | VL | 213 | EIVLTQSPATLSLSPGERATLSCRASSSVTYIHWYQQKPGQAPRSWIYATSNLASGIPARFSGSGSGTDFTLTISSLEPEDFAVYYCQHWSSISPTFGQGTKLEIK |
|  | VH | 212 | EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFSFDYWGQGTTVTVSS |
| P006.038-combo1 | VL | 215 | EIVLTQSPATLSLSPGERATLSCRASSSVTYIHWYQQKPGQAPRSWIYATSNLASGIPARFSGSGSGTDFTLTISSLEPEDFAVYYCQHWSSVPPTFGQGTKLEIK |

TABLE 20-continued

Amino acid sequences of the parental clone A5H1EL1D and selected affinity-matured clones

| Clone | Chain | SEQ ID NO | Sequence |
|---|---|---|---|
| | | | K |
| | VH | 214 | EVQLLESGGGLVQPGGSLRLSCAASGFYFTDYAMN WVRQAPGKGLEWLGVISNKANAYTTEYSASVKGRF TISRDKSKNTLYLQMNSLRAEDTATYYCTRDRGIR FGFDYWGQGTTVTVSS |
| P006.038-combo2 | VL | 217 | EIVLTQSPATLSLSPGERATLSCRASSSVTYIHWY QQKPGQAPRSWIYATSNLASGIPARFSGSGSGTDF TLTISSLEPEDFAVYYCQHWSSVPPTFGQGTKLEI K |
| | VH | 216 | EVQLLESGGGLVQPGGSLRLSCAASGFTFSDYEMN WVRQAPGKGLEWLGFISNKANAYTTEYSASVKGRF TISRDKSKNTLYLQMNSLRAEDTATYYCTRDRGIR FGFDYWGQGTTVTVSS |

10.2.2.4 Fab Purification of Affinity-Matured A5H1EL1D Clones

In order to further characterize the affinity-matured clones, the respective Fab fragments were purified for the exact analysis of the kinetic parameters. For each clone, a 500 ml culture was inoculated with bacteria harboring the corresponding phagemid and induced with 1 mM IPTG at an optical density measured at 600 nm (OD600) of 0.9. Afterwards, the cultures were incubated at 25° C. overnight and harvested by centrifugation. After incubation of the resuspended pellet for 20 min in 25 ml PPB buffer (30 mM Tris-HCl pH8, 1 mM EDTA, 20% sucrose), bacteria were centrifuged again and the supernatant was harvested. This incubation step was repeated once with 25 ml of a 5 mM MgSO4 solution. The supernatants of both incubation steps were pooled, filtered and loaded on an IMAC column (His gravitrap, GE Healthcare). Subsequently, the column was washed with 40 ml washing buffer (500 mM NaCl, 20 mM Imidazole, 20 mM NaH$_2$PO$_4$ pH 7.4). After the elution (500 mM NaCl, 500 mM Imidazole, 20 mM NaH$_2$PO$_4$ pH 7.4) the eluate was re-buffered using PD10 columns (GE Healthcare). The yield of purified protein was in the range of 300 to 500 µg/1.

10.2.2.5 SPR Analysis of Purified Affinity-Matured A5H1EL1D Fab Fragments

Affinity (KD) of purified Fab fragments was measured by surface plasmon resonance using a Proteon XPR36 machine using the same setup as described before.

About 2000, 1000, 500, and 250 RU of biotinylated N(A2B2)A-avi-His were immobilized on 4 channels of a Streptavidin-coated NLC chip in vertical orientation. As a control for non-specific binding, 2000 RU of biotinylated NA(B2)A-avi-His protein was immobilized on channel 5. For the determination of the affinity (KD) of the purified clones, injection direction was changed to horizontal orientation. Two-fold dilution series of purified Fab fragments (varying concentration ranges between 100 and 3 nM) were injected simultaneously at 100 µl/min along separate channels 1-5, with association times of 100s, and dissociation times of 1200s. Buffer (PBST) was injected along the sixth channel to provide an "in-line" blank for referencing. Regeneration was performed with 10 mM glycine pH 1.5 for 35s at 50 µl/min (vertical orientation).

Association rate constants (kon) and dissociation rate constants (koff) were calculated using a simple one-to-one Langmuir binding model in ProteOn Manager v3.1 software by simultaneously fitting the association and dissociation sensorgrams. The equilibrium dissociation constant (KD) was calculated as the ratio koff/kon. The kinetic and thermodynamic data are listed in Table 21.

TABLE 21

Determination of kinetic and thermodynamic parameters of purified Fab-fragments by SPR

| Clone ID | k on (1/Ms) | k off (1/s) | K$_D$ (nM) |
|---|---|---|---|
| A5H1EL1D | 1.08E+5 | 2.48E-4 | 2.3 |
| P006.038 | 2.25E+5 | 5.78E-5 | 0.25 |
| P005.097 | 0.94E+5 | 8.54E-5 | 0.91 |
| P005.103 | 1.00E+5 | 4.99E-5 | 0.5 |
| P002.139 | 1.05E+5 | 6.53E-5 | 0.63 |
| P001.177 | 2.67E+5 | 7.85E-4 | 0.29 |
| P005.102 | 1.34E+5 | 3.92E-4 | 0.29 |

10.2.2.6 Combination of CDR Positions of Affinity-Matured Clones

In an attempt to further increase the affinity to CEA, CDR positions of several previously identified affinity-matured binders were combined with each other. This includes not only specific positions within a CDR but also combinations of CDRs from different binders. An alignment of all clones, phage display-derived and combinatorial clones, is shown in FIGS. 22A and 22B. The CDRs of all heavy chains and light chains are listed in Table 22 and 23, respectively. The VH and VL domains are summarized in Table 20.

TABLE 22

CDR sequences of affinity-matured heavy chains

| Clone | SEQ ID NO | CDR-H1 | SEQ ID NO | CDR-H2 | SEQ ID NO | CDR-H3 |
|---|---|---|---|---|---|---|
| A5H1EL1D | 180 | GFTFTDYYMN | 181 | FIGNKANAYTTEYSASVKG | 182 | DRGLRFYFDY |
| P006.038 | 251 | GFTFTDYYMN | 252 | FIGNKANAYTTEYSASVKG | 253 | DRG<u>IR</u>F<u>G</u>FDY |
| P005.097 | 257 | GFTFTDYYMN | 258 | FIGNKANAYTTEYSASVKG | 259 | DRGLRF<u>S</u>FDY |

TABLE 22-continued

CDR sequences of affinity-matured heavy chains

| Clone | SEQ ID NO | CDR-H1 | SEQ ID NO | CDR-H2 | SEQ ID NO | CDR-H3 |
|---|---|---|---|---|---|---|
| P005.103 | 263 | GFTFTDYYMN | 264 | FIGNKANAYTTEYSASVKG | 265 | DRG*IR*FYFDY |
| P002.139 | 269 | GF*Y*FTDY*A*MN | 270 | *VI*SNKANAYTTEYSASVKG | 271 | DRGLRFYFDY |
| P001.177 | 275 | GF*Y*FTDYYMN | 276 | F*I*SNKANAYTTEYSASVKG | 277 | DRGLRFYFDY |
| P005.102 | 281 | GFTFTDYYMN | 282 | FIGNKANAYTTEYSASVKG | 283 | DRG*IR*F*Q*FDY |
| P005.102-combo1 | 287 | GF*Y*FTDYYMN | 288 | *VI*SNKANAYTTEYSASVKG | 289 | DRG*IR*F*Q*FDY |
| P005.102-combo2 | 293 | GF*YFS*DYYMN | 294 | *VI*SNKANAYTTEYSASVKG | 295 | DRG*IR*F*Q*FDY |
| P005.103-combo1 | 299 | GFTFTDYYMN | 300 | FIGNKANAYTTEYSASVKG | 301 | DRG*IR*F*S*FDY |
| P005.103-combo2 | 305 | GF*Y*FTDYYMN | 306 | *VI*SNKANAYTTEYSASVKG | 307 | DRG*IR*F*S*FDY |
| P006.038-combo1 | 311 | GF*Y*FTDY*A*MN | 312 | *VI*SNKANAYTTEYSASVKG | 313 | DRG*IR*F*G*FDY |
| P006.038-combo2 | 317 | GFTF*S*DY*E*MN | 318 | F*I*SNKANAYTTEYSASVKG | 319 | DRG*IR*F*G*FDY |

TABLE 23

CDR sequences of affinity-matured light chains

| Clone | SEQ ID NO | CDR-L1 | SEQ ID NO | CDR-L2 | SEQ ID NO | CDR-L3 |
|---|---|---|---|---|---|---|
| A5H1EL1D | 183 | RASSSVTYIH | 184 | ATSNLAS | 185 | QHWSSKPPT |
| P006.038 | 254 | RASSSVTYIH | 255 | ATSNLAS | 256 | QHWSS*V*PPT |
| P005.097 | 260 | RASSSVTYIH | 261 | ATSNLAS | 262 | QHWSS*Q*PPT |
| P005.103 | 266 | RASSSVTYIH | 267 | ATSNLAS | 268 | QHWSS*IS*PT |
| P002.139 | 272 | *H*ASSSVTYIH | 273 | ATSNLAS | 274 | QHWSSKPPT |
| P001.177 | 278 | RASSSVTYIH | 279 | ATSNLAS | 280 | QHWSSKPPT |
| P005.102 | 284 | RASSSVTYIH | 285 | ATSNLAS | 286 | QHWSSK*S*PT |
| P005.102-combo1 | 290 | RASSSVTYIH | 291 | ATSNLAS | 292 | QHWSSK*S*PT |
| P005.102-combo2 | 296 | RASSSVTYIH | 297 | ATSNLAS | 298 | QHWSSK*S*PT |
| P005.103-combo1 | 302 | RASSSVTYIH | 303 | ATSNLAS | 304 | QHWSS*IS*PT |
| P005.103-combo2 | 308 | RASSSVTYIH | 309 | ATSNLAS | 310 | QHWSS*IS*PT |
| P006.038-combo1 | 314 | RASSSVTYIH | 315 | ATSNLAS | 316 | QHWSS*V*PPT |
| P006.038-combo2 | 320 | RASSSVTYIH | 321 | ATSNLAS | 322 | QHWSS*V*PPT |

10.3 Generation and Characterization of Affinity-Matured A5H1EL1D-Derived Bispecific Antibodies 10.3.1 Cloning, Production, and Purification of Bispecific Antibodies The variable domains of all clones were synthesized and cloned into plasmids coding for a bispecific 1+1 IgG molecule based on the knob-into-hole mutations and the crossmab technology in combination with PG-LALA mutations. The second binding moiety was specific for CD28. A schematic description of the final molecules is drawn in FIG. 1J. The resulting molecules are composed of the sequences listed in Table 24: All chain combinations expressing the VL and the VH sequences of the affinity-matured binders (SEQ ID NOs: 323-348) were combined with the two chains specific for CD28 (SEQ ID NOs: 349 and 350).

Resulting constructs were prepared by Evitria using their proprietary vector system with conventional (non-PCR based) cloning techniques and using suspension-adapted CHO K1 cells (originally received from ATCC and adapted to serum-free growth in suspension culture at Evitria). For the production, Evitria used its proprietary, animal-component free and serum-free media (eviGrow and eviMake2) and its proprietary transfection reagent (eviFect). Proteins were purified from filtered cell culture supernatants referring to standard protocols. In brief, Fc containing proteins were purified from cell culture supernatants by affinity chromatography using Protein A. Elution was achieved at pH 3.0 followed by immediate neutralization of the sample. The protein was concentrated and aggregated protein was separated from monomeric protein by size exclusion chromatography in 20 mM histidine, 140 mM sodium chloride, pH 6.0.

TABLE 24

Amino acid sequences of the selected affinity-matured anti-CEA clones in bispecific P326G LALA human IgG1 format

| Clone | chain | SEQ ID NO | Polypeptide sequence |
|---|---|---|---|
| A5H1EL1D | VL-CH1-IgG1 Fc- | 323 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGLRFYFDYWGQGTTVTSSASTKGPSVFPLAPS SKSTSGGTAALGCLVKDYFPEPVTVSWNSGALTSGVHTFPAVLQS |

TABLE 24-continued

Amino acid sequences of the selected affinity-matured anti-CEA clones in bispecific P326G LALA human IgG1 format

| Clone | chain | SEQ ID NO | Polypeptide sequence |
|---|---|---|---|
| | (hole, PG-LALA) | | SGLYSLSSVVTVPSSSLGTQTYICNVNHKPSNTKVDKKVEPKSCD KTHTCPPCPAPEAAGGPSVFLFPPKPKDTLMISRIPEVTCVVVDV SHEDPEVKFNWYVDGVEVHNAKTKPREEQYNSTYRVVSVLTVLHQ DWLNGKEYKCKVSNKALGAPIEKTISKAKGQPREPQVCTLPPSRD ELTKNQVSLSCAVKGFYPSDIAVEWESNGQPENNYKTTPPVLDSD GSFFLVSKLTVDKSRWQQGNVFSCSVMHEALHNHYTQKSLSLSP |
| | VH-Ck | 324 | EIVLTQSPATLSLSPGERATLSCRASSSVTYIHWYQQKPGQAPRS WIYATSNLASGIPARFSGSGSGTDFTLTISSLEPEDFAVYYCQHW SSKPPTFGQGTKLEIKRTVAAPSVFIFPPSDEQLKSGTASVVCLL NNFYPREAKVQWKVDNALQSGNSQESVTEQDSKDSTYSLSSTLTL SKADYEKHKVYACEVTHQGLSSPVTKSFNRGEC |
| P006.038 | VL-CH1-IgG1 Fc-(hole, PG-LALA) | 325 | EIVLTQSPATLSLSPGERATLSCRASSSVTYIHWYQQKPGQAPRS WIYATSNLASGIPARFSGSGSGTDFTLTISSLEPEDFAVYYCQHW SSVPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 326 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGIRFGFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.097 | VL-CH1-IgG1 Fc-(hole, PG-LALA) | 327 | EIVLTQSPATLSLSPGERATLSCRASSSVTYIHWYQQKPGQAPRS WIYATSNLASGIPARFSGSGSGTDFTLTISSLEPEDFAVYYCQHW SSQPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 328 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGLRFSFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.103 | VL-CH1-IgG1 Fc-(hole, PG-LALA) | 329 | EIVLTQSPATLSLSPGERATLSCRASSSVTYIHWYQQKPGQAPRS WIYATSNLASGIPARFSGSGSGTDFTLTISSLEPEDFAVYYCQHW SSISPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 330 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGIRFYFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P002.139 | VL-CH1-IgG1 Fc-(hole, PG-LALA) | 331 | EIVLTQSPATLSLSPGERATLSCHASSSVTYIHWYQQKPGQAPRS WIYATSNLASGIPARFSGSGSGTDFTLTISSLEPEDFAVYYCQHW SSKPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS |

TABLE 24-continued

Amino acid sequences of the selected affinity-matured anti-CEA clones in bispecific P326G LALA human IgG1 format

| Clone | chain | SEQ ID NO | Polypeptide sequence |
|---|---|---|---|
| | | | NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 332 | EVQLLESGGGLVQPGGSLRLSCAASGFYFTDYAMNWVRQAPGKGL EWLGVISNKANAYTTEYSASVKGRFTISRDKSKNTLYLQMNSLRA EDTATYYCTRDRGLRFYFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P001.177 | VL-CH1-IgG1 Fc-(hole, PG-LALA) | 333 | EIVLTQSPATLSLSPGERATLSCRASSSVTYIHWYQQKPGQAPRS WIYATSNLASGIPARFSGSGSGTDFTLTISSLEPEDFAVYYCQHW SSKPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 334 | EVQLLESGGGLVQPGGSLRLSCAASGFYFTDYYMNWVRQAPGKGL EWLGFISNKANAYTTEYSASVKGRFTISRDKSKNTLYLQMNSLRA EDTATYYCTRDRGLRFYFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.102 | VL-CH1-IgG1 Fc-(hole, PG-LALA) | 335 | EIVLTQSPATLSLSPGERATLSCRASSSVTYIHWYQQKPGQAPRS WIYATSNLASGIPARFSGSGSGTDFTLTISSLEPEDFAVYYCQHW SSKSPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 336 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCIRDRGIRFQFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.102 -combo1 | VL-CH1-IgG1 Fc-(hole, PG-LALA) | 337 | EIVLTQSPATLSLSPGERATLSCRASSSVTYIHWYQQKPGQAPRS WIYATSNLASGIPARFSGSGSGTDFTLTISSLEPEDFAVYYCQHW SSKSPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 338 | EVQLLESGGGLVQPGGSLRLSCAASGFYFTDYYMNWVRQAPGKGL EWLGVISNKANAYTTEYSASVKGRFTISRDKSKNTLYLQMNSLRA EDTATYYCIRDRGIRFQFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.102 -combo2 | VL-CH1-IgG1 Fc-(hole, PG-LALA) | 339 | EIVLTQSPATLSLSPGERATLSCRASSSVTYIHWYQQKPGQAPRS WIYATSNLASGIPARFSGSGSGTDFTLTISSLEPEDFAVYYCQHW SSKPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK |

TABLE 24-continued

Amino acid sequences of the selected affinity-matured anti-CEA clones in bispecific P326G LALA human IgG1 format

| Clone | chain | SEQ ID NO | Polypeptide sequence |
|---|---|---|---|
| | | | SRWQQGNVFSCSVMHEALHNHYTQKSLSLSP |
| | VH-Ck | 340 | EVQLLESGGGLVQPGGSLRLSCAASGFYFSDYYMNWVRQAPGKGL EWLGVISNKANAYTTEYSASVKGRFTISRDKSKNTLYLQMNSLRA EDTATYYCIRDRGIRFQFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.103 -combo1 | VL- CH1- IgG1 Fc-(hole, PG- LALA) | 341 | EIVLTQSPATLSLSPGERATLSCRASSSVTYIHWYQQKPGQAPRS WIYATSNLASGIPARFSGSGSGTDFTLTISSLEPEDFAVYYCQHW SSISPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 342 | EVQLLESGGGLVQPGGSLRLSCAASGFTFTDYYMNWVRQAPGKGL EWLGFIGNKANAYTTEYSASVKGRFTISRDKSKNTLYLQMNSLRA EDTATYYCTRDRGIRFSFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P005.103 -combo2 | VL- CH1- IgG1 Fc- (hole, PG- LALA) | 343 | EIVLTQSPATLSLSPGERATLSCRASSSVTYIHWYQQKPGQAPRS WIYATSNLASGIPARFSGSGSGTDFTLTISSLEPEDFAVYYCQHW SSISPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 344 | EVQLLESGGGLVQPGGSLRLSCAASGFYFTDYYMNWVRQAPGKGL EWLGVISNKANAYTTEYSASVKGRFTISRDKSKNTLYLQMNSLRA EDTATYYCTRDRGIRFSFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P006.038 -combo1 | VL- CH1- IgG1 Fc- (hole, PG- LALA) | 345 | EIVLTQSPATLSLSPGERATLSCRASSSVTYIHWYQQKPGQAPRS WIYATSNLASGIPARFSGSGSGTDFTLTISSLEPEDFAVYYCQHW SSVPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |
| | VH-Ck | 346 | EVQLLESGGGLVQPGGSLRLSCAASGFYFTDYAMNWVRQAPGKGL EWLGVISNKANAYTTEYSASVKGRFTISRDKSKNTLYLQMNSLRA EDTATYYCIRDRGIRFGFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| P006.038 -combo2 | VL- CH1- IgG1 Fc- (hole, PG- LALA) | 347 | EIVLTQSPATLSLSPGERATLSCRASSSVTYIHWYQQKPGQAPRS WIYATSNLASGIPARFSGSGSGTDFTLTISSLEPEDFAVYYCQHW SSVPPTFGQGTKLEIKSSASTKGPSVFPLAPSSKSTSGGTAALGC LVKDYFPEPVTVSWNSGALTSGVHTFPAVLQSSGLYSLSSVVTVP SSSLGTQTYICNVNHKPSNTKVDKKVEPKSCDKTHTCPPCPAPEA AGGPSVFLFPPKPKDTLMISRTPEVTCVVVDVSHEDPEVKFNWYV DGVEVHNAKTKPREEQYNSTYRVVSVLTVLHQDWLNGKEYKCKVS NKALGAPIEKTISKAKGQPREPQVCTLPPSRDELTKNQVSLSCAV KGFYPSDIAVEWESNGQPENNYKTTPPVLDSDGSFFLVSKLTVDK SRWQQGNVFSCSVMHEALHNHYTQKSLSLSP |

TABLE 24-continued

Amino acid sequences of the selected affinity-matured anti-CEA clones in bispecific P326G LALA human IgG1 format

| Clone | chain | SEQ ID NO | Polypeptide sequence |
|---|---|---|---|
| | VH-Ck | 348 | EVQLLESGGGLVQPGGSLRLSCAASGFTFSDYEMNWVRQAPGKGL EWLGFISNKANAYTTEYSASVKGRFTISRDKSKNTLYLQMNSLRA EDTATYYCIRDRGIRFGFDYWGQGTTVTVSSASVAAPSVFIFPPS DEQLKSGTASVVCLLNNFYPREAKVQWKVDNALQSGNSQESVTEQ DSKDSTYSLSSTLTLSKADYEKHKVYACEVTHQGLSSPVTKSFNR GEC |
| CD28 (SA_ Variant 15) | VH-CH1-IgG1 Fc (knob, PG-LALA) | 349 | QVQLVQSGAEVKKPGASVKVSCKASGYTFTSYYIHWVRQAPGQGL EWIGSIYPGNVQTNYNEKFKDRATLTVDTSISTAYMELSRLRSDD TAVYFCTRSHYGLDWNFDVWGQGTTVTVSSASTKGPSVFPLAPSS KSTSGGTAALGCLVEDYFPEPVTVSWNSGALTSGVHTFPAVLQSS GLYSLSSVVTVPSSSLGTQTYICNVNHKPSNTKVDEKVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALGAPIEKTISKAKGQPREPQVYTLPPCRDE LTKNQVSLWCLVKGFYPSDIAVEWESNGQPENNYKTTPPVLDSDG SFFLYSKLTVDKSRWQQGNVFSCSVMHEALHNHYTQKSLSLSP |
| | VL-Ck | 350 | DIQMTQSPSSLSASVGDRVTITCHASQNIYVFLNWYQQKPGKAPK LLIYKASNLHTGVPSRFSGSGSGTDFTLTISSLQPEDFATYYCQQ GQTYPYTFGGGTKVEIKRTVAAPSVFIFPPSDRKLKSGTASVVCL LNNFYPREAKVQWKVDNALQSGNSQESVTEQDSKDSTYSLSSTLT LSKADYEKHKVYACEVTHQGLSSPVTKSFNRGEC |

10.3.2 Affinity Determination of Selected Antibodies by SPR

The Affinity ($K_D$) of the parental antibody A5H1EL1D as well as its affinity-matured derivatives was measured by SPR using a ProteOn XPR36 instrument (Biorad) at 25° C.

About 2000, 1000, 500, and 250 RU of biotinylated N(A2B2)A-avi-His were immobilized on 4 channels of a Streptavidin-coated NLC chip in vertical orientation. As a control for non-specific binding, 2000 RU of biotinylated NA(B2)A-avi-His protein was immobilized on channel 5. For the determination of the affinity ($K_D$) of the purified bispecific constructs, injection direction was changed to horizontal orientation. Two-fold dilution series of purified bi-specific IgGs (varying concentration ranges between 25 and 1.56 nM) were injected simultaneously at 100 µl/min along separate channels 1-5, with association times of 180s, and dissociation times of 1200s. Buffer (PBST) was injected along the sixth channel to provide an "in-line" blank for referencing. Regeneration was performed with 10 mM glycine pH 1.5 for 20s at 50 ul/min (vertical orientation).

Association rate constants (kon) and dissociation rate constants (koff) were calculated using a simple one-to-one Langmuir binding model in ProteOn Manager v3.1 software by simultaneously fitting the association and dissociation sensorgrams. The equilibrium dissociation constant ($K_D$) was calculated as the ratio koff/kon. All kinetic and thermodynamic data are listed in Table 25. Higher affinity (lower $K_D$ values) were observed for the affinity-matured clones that were identified by the phage display selection. In addition, combinations with exchanged CDRs and CDR positions were tested. While some combinations (e.g. clones "P005.103-combo2" and "P005.102-combo1") resulted in very slow off-rates and consequently very high affinities, the affinity was significantly reduced in 2 combinatorial clones (clones "P006.038-combo1" and "P006.038-combo2").

TABLE 25

Determination of kinetic and thermodynamic parameters of purified bi-specific CEA-CD28 constructs by SPR

| Clone ID | k on (1/Ms) | k off (1/s) | $K_D$ (nM) |
|---|---|---|---|
| A5H1EL1D | 1.58E+5 | 3.33E−4 | 2.11 |
| P006.038 | 2.67E+5 | 5.87E−5 | 0.22 |
| P005.097 | 2.69E+5 | 8.87E−5 | 0.33 |
| P005.103 | 2.57E+5 | 1.12E−4 | 0.44 |
| P002.139 | 2.49E+5 | 9.70E−5 | 0.39 |
| P001.177 | 2.05E+5 | 8.83E−5 | 0.43 |
| P005.102 | 1.60E+5 | 3.31E−5 | 0.20 |
| P005.102-combo1 | 2.07E+5 | 1.23E−5 | 0.06 |
| P005.102-combo2 | 2.25E+5 | 1.85E−5 | 0.08 |
| P005.103-combo1 | 1.26E+5 | 3.42E−5 | 0.27 |
| P005.103-combo2 | 1.23E+5 | 1.05E−5 | 0.09 |
| P006.038-combo1 | 1.78E+5 | 7.99E−5 | 4.48 |
| P006.038-combo2 | 1.91E+5 | 6.98E−4 | 3.66 |

Example 11

Generation and Production of Further Bispecific Antigen Binding Molecules Targeting CD28 and Carcinoembryonic Antigen (CEA)

11.1 Cloning of the Bispecific Antigen Binding Molecules

For the generation of the expression plasmids, the sequences of the respective variable domains were used and sub-cloned in frame with the respective constant regions which are pre-inserted in the respective recipient mammalian expression vector. A schematic description of the resulting molecules is shown in FIG. 23. In the Fc domain, Pro329Gly, Leu234Ala and Leu235Ala mutations (PG-LALA) have been introduced in the constant region of the human IgG1 heavy chains to abrogate binding to Fc gamma receptors according to the method described in International Patent Appl. Publ. No. WO 2012/130831. For the generation of bispecific antibodies, Fc fragments contained either the "knob" (S354C/T366W mutations, numbering according to Kabat EU index) or "hole" mutations (Y349C/T366S/

L368A/Y407V mutations according to Kabat EU index) to avoid mispairing of the heavy chains. In order to avoid mispairing of light chains in the bispecific antigen binding molecules, exchange of VH/VL or CH1/Ckappa domains was introduced in one binding moiety (CrossFab technology). In another binding moiety, charges were introduced into the CH1 and Ckappa domains as described in International Patent Appl. Publ. No. WO 2015/150447. The generation and preparation of anti-CEA clone T84.66 is described in WO 2016/075278 A2.

The following molecules were cloned, a schematic illustration thereof is shown in FIGS. 23A to 23D:

Molecule 11A: CEA (A5H1EL1D)-CD28 (SA) 1+1 format, bispecific huIgG1 PG-LALA CrossFab molecule with charged modifications in the CD28(SA) Fab fragment (knob) and VH/VL exchange in CEA(A5H1EL1D) Fab fragment (hole) (FIG. 23A) comprising the amino acid sequences of SEQ ID Nos: 351, 352, 353 and 354 (P1AE4773).

Molecule 11B: CEA (A5H1EL1D)-CD28 (SA_Variant 8) 1+1 format, bispecific huIgG1 PG-LALA CrossFab molecule with charged modifications in the CD28(SA_Variant 8) Fab fragment (knob) and VH/VL exchange in CEA (A5H1EL1D) Fab fragment (hole) (FIG. 23A) comprising the amino acid sequences of SEQ ID Nos: 351, 352, 355 and 356 (P1AE4774).

Molecule 11C: CEA (A5H1EL1D)-CD28 (SA_Variant 15) 1+1 format, bispecific huIgG1 PG-LALA CrossFab molecule with charged modifications in the CD28(SA_Variant 15) Fab fragment (knob) and VH/VL exchange in CEA (A5H1EL1D) Fab fragment (hole) (FIG. 23A) comprising the amino acid sequences of SEQ ID Nos: 351, 352, 357 and 358 (P1AE4775).

Molecule 11D: CEA (A5H1EL1D)-CD28 (SA_Variant 29) 1+1 format, bispecific huIgG1 PG-LALA CrossFab molecule with charged modifications in the CD28(SA_Variant 29) Fab fragment (knob) and VH/VL exchange in CEA (A5H1EL1D) Fab fragment (hole) (FIG. 23A) comprising the amino acid sequences of SEQ ID Nos: 351, 352, 359 and 354 (P1AE4776).

Molecule 11E: CEA (A5H1EL1D)-CD28 (SA) 1+1 format, bispecific huIgG1 PG-LALA CrossFab molecule with VH/VL exchange in the CD28(SA) Fab fragment (knob) and charged modifications in the CEA(A5H1EL1D) Fab fragment (hole) (FIG. 23B) comprising the amino acid sequences of SEQ ID Nos: 360, 361, 362 and 363 (P1AE4777).

Molecule 11F: CEA (A5H1EL1D)-CD28 (SA_Variant 8) 1+1 format, bispecific huIgG1 PG-LALA CrossFab molecule with VH/VL exchange in the CD28 (SA_Variant 8) Fab fragment (knob) and charged modifications in the CEA (A5H1EL1D) Fab fragment (hole) (FIG. 23B) comprising the amino acid sequences of SEQ ID Nos: 360, 361, 364 and 365 (P1AE4780).

Molecule 11G: CEA (A5H1EL1D)-CD28 (SA_Variant 15) 1+1 format, bispecific huIgG1 PG-LALA CrossFab molecule with VH/VL exchange in the CD28 (SA_Variant 15) Fab fragment (knob) and charged modifications in the CEA (A5H1EL1D) Fab fragment (hole) (FIG. 23B) comprising the amino acid sequences of SEQ ID Nos: 360, 361, 366 and 367 (P1AE4791).

Molecule 11H: CEA (A5H1EL1D)-CD28 (SA_Variant 29) 1+1 format, bispecific huIgG1 PG-LALA CrossFab molecule with VH/VL exchange in the CD28 (SA_Variant 29) Fab fragment (knob) and charged modifications in the CEA (A5H1EL1D) Fab fragment (hole) (FIG. 23B) comprising the amino acid sequences of SEQ ID Nos: 360, 361, 368 and 363 (P1AE4793).

Molecule 11I: CEA (T84.66)-CD28 (SA) 1+1 format, bispecific huIgG1 PG-LALA CrossFab molecule with charged modifications in the CD28(SA) Fab fragment (knob) and VH/VL exchange in CEA(T84.66) Fab fragment (hole) (FIG. 23A) comprising the amino acid sequences of SEQ ID Nos: 369, 370, 353 and 354 (P1AE6488).

Molecule 11J: CEA (T84.66)-CD28 (SA_Variant 29) 1+1 format, bispecific huIgG1 PG-LALA CrossFab molecule with charged modifications in the CD28(SA_Variant 29) Fab fragment (knob) and VH/VL exchange in CEA (T.84.66) Fab fragment (hole) (FIG. 23A) comprising the amino acid sequences of SEQ ID Nos: 369, 370, 359 and 354 (P1AE6495).

Molecule 11K: CEA (T84.66)-CD28 (SA_Variant 15) 1+1 format, bispecific huIgG1 PG-LALA CrossFab molecule with charged modifications in the CD28(SA_Variant 15) Fab fragment (knob) and VH/VL exchange in CEA(T84.66) Fab fragment (hole) (FIG. 23A) comprising the amino acid sequences of SEQ ID Nos: 369, 370, 357 and 358 (P1AE6557).

Molecule 11L: CEA (T84.66)-CD28 (SA_Variant 8) 1+1 format, bispecific huIgG1 PG-LALA CrossFab molecule with charged modifications in the CD28(SA_Variant 8) Fab fragment (knob) and VH/VL exchange in CEA(T84.66) Fab fragment (hole) (FIG. 23A) comprising the amino acid sequences of SEQ ID Nos: 369, 370, 355 and 356 (P1AE6556).

Molecule 11M: CEA (T84.66)-CD28 (SA_Variant 29) 1+1 format, bispecific huIgG1 PG-LALA CrossFab molecule with VH/VL exchange in the CD28(SA_Variant 29) Fab fragment (knob) and charged modifications in the CEA (T84.66) Fab fragment (hole) (FIG. 23B) comprising the amino acid sequences of SEQ ID Nos: 371, 372, 368 and 363 (P1 AE9605).

Molecule 11N: CEA (T84.66)-CD28 (SA_Variant 8) 1+1 format, bispecific huIgG1 PG-LALA CrossFab molecule with VH/VL exchange in the CD28 (SA_Variant 8) Fab fragment (knob) and charged modifications in the CEA (T84.66) Fab fragment (hole) (FIG. 23B) comprising the amino acid sequences of SEQ ID Nos 371, 372, 366 and 367 (P1AE9606).

Molecule 11O: CEA (T84.66)-CD28 (SA_Variant 15) 1+1 format, bispecific huIgG1 PG-LALA CrossFab molecule with VH/VL exchange in the CD28 (SA_Variant 15) Fab fragment (knob) and charged modifications in the CEA (T84.66) Fab fragment (hole) (FIG. 23B) comprising the amino acid sequences of SEQ ID Nos: 371, 372, 364 and 365 (P1AE9607).

Molecule 11P: CEA (A5H1EL1D)-CD28 (SA-Variant 29) 2+1, bispecific monovalent anti-CD28 (SA_Variant 29) and bivalent anti-CEA huIgG1 PG-LALA CrossFab construct, charged modifications in both anti-CEA Fab fragments fused head to tail to each other (hole), VH/VL exchange in the anti-CD28 CrossFab fragment (knob) (FIG. 23C). The molecule comprises the amino acid sequences of SEQ ID NOs: 368, 362, 361 and 373 (P1AE6924).

Molecule 11Q: CEA (A5H1EL1D)-CD28 (SA_Variant 29) 2+1, bispecific monovalent anti-CD28 (SA) and bivalent anti-CEA huIgG1 PG-LALA CrossFab construct, "classical orientation", VH/VL exchange in the anti-CD28 CrossFab fragment, charged modification in both anti-CEA Fab fragments (FIG. 23D). The molecule comprises the amino acid sequences of SEQ ID NOs: 368, 374, 361 and 360 (P1AE6925).

Molecule 11R: CEA (P002.139)-CD28 (SA_Variant 15) 1+1 format, bispecific huIgG1 PG-LALA CrossFab molecule with charged modifications in the CD28(SA_Variant 15) Fab fragment (knob) and VH/VL exchange in CEA(P002.139) Fab fragment (hole) (FIG. 23A) comprising the amino acid sequences of SEQ ID Nos: 375, 376, 357 and 358 (P1AE8371).
Molecule 11S: CEA (P002.139)-CD28 (SA_Variant 8) 1+1 format, bispecific huIgG1 PG-LALA CrossFab molecule with charged modifications in the CD28(SA_Variant 8) Fab fragment (knob) and VH/VL exchange in CEA(P002.139) Fab fragment (hole) (FIG. 23A) comprising the amino acid sequences of SEQ ID Nos: 375, 376, 355 and 356 (P1AF1115).
Molecule 11T: CEA (P002.139)-CD28 (SA_Variant 11) 1+1 format, bispecific huIgG1 PG-LALA CrossFab molecule with charged modifications in the CD28(SA_Variant 11) Fab fragment (knob) and VH/VL exchange in CEA(P002.139) Fab fragment (hole) (FIG. 23A) comprising the amino acid sequences of SEQ ID Nos: 375, 376, 355 and 354 (P1AF1116).

For comparison the following anti-CD28 antibody variants were made:
Molecule 11U: CD28(SA_Variant 8) (PG-LALA), CD28 (SA_Variant 8) antibody in a huIgG1 PG-LALA isotype (FIG. 1B) comprises the amino acid sequences of SEQ ID NO:377 and SEQ ID NO:378 (P1AE7035).
Molecule 11V: CD28(SA_Variant 11) (PG-LALA), CD28 (SA_Variant 11) antibody in a huIgG1 PG-LALA isotype (FIG. 1B) comprises the amino acid sequences of SEQ ID NO:379 and SEQ ID NO:380 (P1AE7036).
Molecule 11W: CD28(SA_Variant 15) (PG-LALA), CD28 (SA_Variant 15) antibody in a huIgG1 PG-LALA isotype (FIG. 1B) comprises the amino acid sequences of SEQ ID NO:381 and SEQ ID NO:382 (P1 AE7037).
Molecule 11X: CD28(SA_Variant 27) (PG-LALA), CD28 (SA_Variant 27) antibody in a huIgG1 PG-LALA isotype (FIG. 1B) comprises the amino acid sequences of SEQ ID NO:383 and SEQ ID NO:384 (P1AE7038).
Molecule 11Y: CD28(SA_Variant 29) (PG-LALA), CD28 (SA_Variant 29) antibody in a huIgG1 PG-LALA isotype (FIG. 1B) comprises the amino acid sequences of SEQ ID NO:385 and SEQ ID NO:386 (P1AE7039).

11.2 Production of the Molecules

Expression of the above-mentioned molecules is either driven by a chimeric MPSV promoter or a CMV promoter. Polyadenylation is driven by a synthetic polyA signal sequence located at the 3' end of the CDS. In addition, each vector contains an EBV OriP sequence for autosomal replication.

For the production of the Molecules 11A to 11D and 11I to 11T, HEK293-EBNA cells that grow in suspension were co-transfected with the respective expression vectors using polyethylenimine as a transfection reagent. Antibodies and bispecific antibodies were generated by transient transfection of HEK293 EBNA cells. Cells were centrifuged and medium replaced by pre-warmed CD CHO medium. Expression vectors were mixed in CD CHO medium, PEI was added, the solution vortexed and incubated for 10 minutes at room temperature. Afterwards, cells were mixed with the DNA/PEI solution, transferred to shake flask and incubated for 3 hours at 37° C. in an incubator with a 5% $CO_2$ atmosphere. After the incubation, Excell medium with supplements was added (Mammalian Cell Cultures for Biologics Manufacturing, Editors: Weichang Thou, Anne Kantardjieff). One day after transfection supplements (Feed) were added (Mammalian Cell Cultures for Biologics Manufacturing, Editors: Weichang Thou, Anne Kantardjieff). Cell supernatants were harvested after 7 days by centrifugation and subsequent filtration (0.2 µm filter) and purified by standard methods.

Molecules 11U, 11V, 11W, 11X, and 11Y were produced and purified by Evitria using their proprietary vector system with conventional (non-PCR based) cloning techniques and using suspension-adapted CHO K1 cells (originally received from ATCC and adapted to serum-free growth in suspension culture at Evitria). For the production, Evitria used its proprietary, animal-component free and serum-free media (eviGrow and eviMake2) and its proprietary transfection reagent (eviFect). Supernatant was harvested by centrifugation and subsequent filtration (0.2 µm filter) and purified by standard methods. Molecules 11E, 11F, 11G and 11H were produced and purified by Proteros according to their standard methods and protocols.

11.3 Purification of the Molecules

Proteins were purified from filtered cell culture supernatants referring to standard protocols. In brief, Fc containing proteins were purified from cell culture supernatants by Protein A-affinity chromatography (equilibration buffer: 20 mM sodium citrate, 20 mM sodium phosphate, pH 7.5; elution buffer: 20 mM sodium citrate, pH 3.0). Elution was achieved at pH 3.0 followed by immediate pH neutralization of the sample. The protein was concentrated by centrifugation (Millipore Amicon® ULTRA-15 (Art.Nr.: UFC903096), and aggregated protein was separated from monomeric protein by size exclusion chromatography in 20 mM histidine, 140 mM sodium chloride, pH 6.0.

11.4 Analytical Data of Bispecific Antigen Binding Molecules Targeting CD28 and Carcinoembryonic Antigen (CEA)

The concentration of purified proteins was determined by measuring the absorption at 280 nm using the mass extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII (Perkin Elmer). Determination of the aggregate content was performed by HPLC chromatography at 25° C. using analytical size-exclusion column (TSKgel G3000 SW XL or UP-SW3000) equilibrated in running buffer (25 mM $K_2HPO_4$, 125 mM NaCl, 200 mM L-Arginine Monohydrocloride, pH 6.7 or 200 mM $KH_2PO_4$, 250 mM KCl pH 6.2 respectively). A summary of the purification parameters of all molecules is given in Table 26.

TABLE 26

Summary of the production and purification of CD28 antigen binding molecules 11A to 11Y

| Molecule | Description | Yield [mg/l] | Analytical SEC (HMW/Monomer/LMW) [%] | Purity measured by CE-SDS [%] |
|---|---|---|---|---|
| 11A | CEA (A5H1EL1D)-CD28 (SA) 1 + 1 | 11.4 | 0/100/0 | 97.8 |
| 11B | CEA (A5H1EL1D)-CD28 (SA_Variant 8) 1 + 1 | 11.3 | 0/100/0 | 98.2 |
| 11C | CEA (A5H1EL1D)-CD28 (SA_Variant 15) 1 + 1 | 45.1 | 0/100/0 | 97.1 |
| 11D | CEA (A5H1EL1D)-CD28 (SA_Variant 29) 1 + 1 | 58.1 | 0/100/0 | 96.6 |

TABLE 26-continued

Summary of the production and purification of
CD28 antigen binding molecules 11A to 11Y

| Molecule | Description | Yield [mg/l] | Analytical SEC (HMW/Monomer/LMW) [%] | Purity measured by CE-SDS [%] |
|---|---|---|---|---|
| 11E | CEA (A5H1EL1D)-CD28 (SA, crossed) 1 + 1 | N/A | 0.97/95.2/3.93 | 98.8 |
| 11F | CEA (A5H1EL1D)-CD28 (SA_Variant 8, crossed) 1 + 1 | N/A | 0.3/96.83/2.86 | 96.43 |
| 11G | CEA (A5H1EL1D)-CD28 (SA_Variant 15, crossed) 1 + 1 | N/A | 0.1/98.34/1.56 | 97.9 |
| 11H | CEA (A5H1EL1D)-CD28 (SA_Variant 29, crossed) 1 + 1 | N/A | 1.07/96.03/2.9 | 95.79 |
| 11I | CEA (T84.66)-CD28 (SA) 1 + 1 | | N/A | |
| 11J | CEA (T84.66)-CD28 (SA_Variant 29) 1 + 1 | 25.2 | 3.33/96.14/0.53 | 97.8 |
| 11K | CEA (T84.66)-CD28 (SA_Variant 15) 1 + 1 | 3 | 5.19/93.06/1.75 | 96.32 |
| 11L | CEA (T84.66)-CD28 (SA_Variant 8) 1 + 1 | 7.8 | 5.12/95.5/1.84 | 95.5 |
| 11M | CEA (T84.66)-CD28 (SA_variant 29, crossed) 1 + 1 | | N/A | |
| 11N | CEA (T84.66)-CD28 (SA_Variant 15, crossed) 1 + 1 | | N/A | |
| 11O | CEA (T84.66)-CD28 (SA_Variant 8, crossed) 1 + 1 | | N/A | |
| 11P | CEA (A5H1EL1D, head to tail)-CD28 (SA_Variant 29) 2 + 1 | | N/A | |
| 11Q | CEA (A5H1EL1D-CD28 (SA_variant 29) 2 + 1, classical | | N/A | |
| 11R | CEA(P002.139)-CD28 (SA_Variant 15) 1 + 1 | 7.27 | 044/99.56/0 | 100 |
| 11S | CEA(P002.139)-CD28 (SA_Variant 8) 1 + 1 | 12 | 0.57/97.68/1.75 | 99.44 |
| 11T | CEA(P002.139)-CD28 (SA_Variant 11) 1 + 1 | 7.25 | 0.7/96.61/2.69 | 95.1 |
| 11U | CD28 (SA_Variant 8) IgG1 PG LALA | N/A | 0/98.43/1.57 | 80.2 |
| 11V | CD28 (SA_Variant 11) IgG1 PG LALA | N/A | 0/98.52/1.48 | 72.5 |
| 11W | CD28 (SA_Variant 15) IgG1 PG LALA | N/A | 1.49/97.44/1.07 | 82 |
| 11X | CD28 (SA_Variant 27) IgG1 PG LALA | N/A | 1.46/97.15/1.39 | 84.6 |
| 11Y | CD28 (SA_Variant 29) IgG1 PG LALA | N/A | 1.02/97.3 1.68 | 84.4 |

11.5 Binding Analysis of Bispecific Antigen Binding Molecules Targeting CD28 and Carcinoembryonic Antigen (CEA) by SPR Affinity ($K_D$) to CD28 of Molecules 10A-10D, which bear the anti-CEA antibody A5H1EL1D and the anti-CD28 binder variants 8, 11, and 29 as well as the original binder CD28(SA), were measured by SPR by surface plasmon resonance using a Proteon XPR36 machine. For the immobilization of recombinant antigen (ligand), huCD28-Fc was diluted with PBST (10 mM phosphate, 150 mM sodium chloride pH 7.4, 0.005% Tween 20) to concentrations ranging from 100 to 500 nM, and then injected at 25 μl/minute at varying contact times. This resulted in immobilization levels between 500 to 3000 response units (RU) in vertical orientation.

For the determination of the affinity (KD) of the purified molecules, injection direction was changed to horizontal orientation. Two-fold dilution series of purified constructs (varying concentration ranges between 100 and 6.25 nM) were injected simultaneously at 100 μl/min along separate channels 1-5, with association times of 150s, and dissociation times of 400s. Buffer (PBST) was injected along the sixth channel to provide an "in-line" blank for referencing. Regeneration was performed with 10 mM glycine pH 1.5 for 35s at 50 μl/min (vertical orientation). Association rate constants (kon) and dissociation rate constants (koff) were calculated using a simple one-to-one Langmuir binding model in ProteOn Manager v3.1 software by simultaneously fitting the association and dissociation sensorgrams. The equilibrium dissociation constant (KD) was calculated as the ratio koff/kon. The kinetic and thermodynamic data are listed in Table 27.

TABLE 27 kinetic and thermodynamic analysis of anti-CD28
variants in bispecific molecules 11A to 11P

| Bispecific molecule | $k_{on}$ (1/(s*M)) | $k_{off}$ (1/s) | $K_D$ (nM) |
|---|---|---|---|
| CEA (A5H1EL1D)-CD28 (SA) 1 + 1 | 3.77E+5 | 2.94E−4 | 0.8 |
| CEA (A5H1EL1D)-CD28 (CD28(SA_Variant 8) 1 + 1 | 1.69E+5 | 9.80E−3 | 58 |
| CEA (A5H1EL1D)-CD28 (CD28(SA_Variant 15) 1 + 1 | 2.59E+5 | 2.64E−3 | 10 |
| CEA (A5H1EL1D)-CD28 (CD28(SA_Variant 29) 1 + 1 | 2.71E+5 | 3.24E−4 | 1.2 |

11.6 Biochemical Characterization of the Anti-CD28 IgG Variants and Selected 1+1 Bispecific CEA-Targeted Anti-CD28 Antigen Binding Molecules In order to characterize and compare their biochemical and biophysical properties, the following molecules were analyzed in detail: CEA-targeted anti-CD28 bispecific variants Molecules 10A-10D and anti-CD28 IgG variants Molecules 10U-10Y. The results are summarized in Tables 27 and 28.

Hydrophobic Interaction Chromatography (HIC)

Apparent hydrophobicity was determined by injecting 20 pg of sample onto a HIC-Ether-5PW (Tosoh) column equilibrated with 25 mM Na-phosphate, 1.5 M ammonium sulfate, pH 7.0. Elution was performed with a linear gradient from 0 to 100% buffer B (25 mM Na-phosphate, pH 7.0) within 60 minutes. Retention times were compared to protein standards with known hydrophobicity. Most antibodies display a relative retention time between 0 and 0.35.

Thermal Stability

Samples were prepared at a concentration of 1 mg/mL in 20 mM Histidine/Histidine chloride, 140 mM NaCl, pH 6.0, transferred into an optical 384-well plate by centrifugation through a 0.4 μm filter plate and covered with paraffine oil. The hydrodynamic radius was measured repeatedly by dynamic light scattering on a DynaPro Plate Reader (Wyatt) while the samples were heated with a rate of 0.05° C./min from 25° C. to 80° C.

FcRn Affinity Chromatography

FcRn was expressed, purified and biotinylated as described by Cymer, Schlothauer et al., Bioanalysis 2017, 9(17), doi.org/10.4155/bio-2017-0109. For coupling, the prepared receptor was added to streptavidin-sepharose (GE Healthcare). The resulting FcRn-sepharose matrix was packed in a column housing. The column was equilibrated with 20 mM 2-(N-morpholine)-ethanesulfonic acid (MES), 140 mM NaCl, pH 5.5 (eluent A) at a 0.5 ml/min flow rate. 30 pg of antibody samples were diluted at a volume ratio of 1:1 with eluent A and applied to the FcRn column. The column was washed with 5 column volumes of eluent A followed by elution with a linear gradient from 20 to 100% 20 mM Tris/HCl, 140 mM NaCl, pH 8.8 (eluent B) in 35 column volumes. The analysis was performed with a column oven at 25° C. The elution profile was monitored by continuous measurement of the absorbance at 280 nm. Retention times were compared to protein standards with known affinities. Most antibodies display a relative retention time between 0 and 1.

Heparin Affinity Chromatography

Heparin affinity was determined by injecting 30-50 pg of sample onto a TSKgel Heparin-5PW (Tosoh) column equilibrated with 50 mM Tris, pH 7.4. Elution was performed with a linear gradient from 0 to 100% buffer B (50 mM Tris, 1M NaCl, pH 7.4 mM) within 37 minutes. Retention times were compared to protein standards with known affinities.

All tested sequence variants passed all criteria and do not significantly differ from each other with regard to all tested biophysical and biochemical properties (Tables 28 and 29).

TABLE 28

Biophysical and biochemical properties of tested anti-CD28 IgG variants 10U-10Y

| Sample | Thermal stability (° C.) | Apparent hydophobicity | FcRn affinity | Heparin affinity |
|---|---|---|---|---|
| CD28 (SA_Variant 8) IgG1 PG LALA | 79 | 0.218 | 0.17 | 0.58 |
| CD28 (SA_Variant 11) IgG1 PG LALA | 78 | 0.313 | 0.21 | 0.58 |
| CD28 (SA_Variant 15) IgG1 PG LALA | 79 | 0.265 | 0.25 | 0.59 |
| CD28 (SA_Variant 27) IgG1 PG LALA | 78 | 0.194 | 0.28 | 0.59 |
| CD28 (SA_Variant 29) IgG1 PG LALA | 78 | 0.308 | 0.37 | 0.59 |

TABLE 29

Biophysical and biochemical properties of tested bispecific CEA-targeted anti-CD28 variant molecules 11A-11D

| Sample | Thermal stability (° C.) | Apparent hydophobicity | FcRn affinity | Heparin affinity |
|---|---|---|---|---|
| CEA (A5H1EL1D)-CD28 (SA) 1 + 1 | 70 | 0.22 | 0.21 | 0.66 |
| CEA (A5H1EL1D)-CD28 (SA_Variant 8) 1 + 1 | 67 | 0.17 | 0.08 | 0.66 |
| CEA (A5H1EL1D)-CD28 (SA_Variant 15) 1 + 1 | 70 | 0.19 | 0.1 | 0.66 |

TABLE 29-continued

Biophysical and biochemical properties of tested bispecific CEA-targeted anti-CD28 variant molecules 11A-11D

| Sample | Thermal stability (° C.) | Apparent hydophobicity | FcRn affinity | Heparin affinity |
|---|---|---|---|---|
| CEA (A5H1EL1D)-CD28 (SA_Variant 29) 1 + 1 | 70 | 0.22 | 0.17 | 0.67 |

Example 12

In Vitro Functional Characterization of Bispecific Antigen Binding Molecules Targeting CD28 and Carcinoembryonic Antigen (CEA)

12.1 Binding to CEACAM5 on CEA-Expressing MV3 Cells

To assess whether affinity-maturation of A5H1EL1D resulted in improved binding to CEACAM5, a FACS binding assay on MV3 cells, genetically modified to express CEA, was performed. As shown in FIG. 24, a CEA-CD28 bispecific antibody (Molecule 11R, P1AE8371) carrying the affinity-matured anti-CEA clone P002.139 showed superior binding ($EC_{50}$=4.1 nM) to CEACAM5 than the A5H1EL1 D clone (Molecule 11C, P1AE4775) ($EC_{50}$=20.4 nM).

12.2 IL-2 Reporter Assay to Analyze In Vitro Functionality of CEA-CD28 Bispecific Antibodies in Combination with CEA-Targeted TCBs IL-2 reporter cells (J1631, Promega) are genetically engineered Jurkat T cells that express a luciferase reporter driven by an IL-2 promoter. To assess the ability of CEA-targeted CD28 agonists to enhance TCB-mediated T cell effector function, 10000 MKN45 cells/well were incubated with $10^5$ IL-2 reporter cells (E:T ratio 10:1) with fixed concentration of CEA-TCB (5 nM) and a concentration range of CEA-CD28 bispecific antibodies (14 pM-10 nM). After 6 h of incubation at 37° C., 5% $CO_2$, luminescence was assessed using OneGlo (E6120, Promega) according to manufacturer's instructions. Plates were read via Tecan Spark 10M Plate Reader.

The functionality of CEA-CD28 bispecific antibody carrying either the affinity-matured anti-CEA clone P002.139 (Molecule 11R, P1AE8371) or the clone A5H1EL1D (Molecule 11C, P1AE4775) was assessed using an IL-2 reporter cell assay in combination with CEA-TCB (5 nM) and in presence of CEA-expressing MKN45 cells. As shown in FIGS. 25A and 25B, improved affinity of the affinity-matured clone P002.139 translated to higher potency in costimulatory capacity as compared to the clone A5H1EL1D.

Example 13

In Vivo Functional Characterization of Bispecific Antigen Binding Molecules Targeting CD28 and Carcinoembryonic Antigen (CEA) in Combination with CEA TCB 13.1 Efficacy Study with CEA-CD28 Bispecific Antigen Binding Molecules with Different CEA Antigen Binding Domains in Combination with CEA-TCB in MKN45 Xenograft in Humanized Mice The efficacy study described herein was aimed to understand the CEA-clone dependent potency of the CEA-CD28 bispecific antigen binding molecule in combination with CEA-TCB in terms of tumor regression in fully humanized NSG mice.

Human MKN45 cells (human gastric carcinoma) were originally obtained from ATCC and after expansion deposited in the Glycart internal cell bank. Cells were cultured in DMEM containing 10% FCS at 37° C. in a water-saturated atmosphere at 5% $CO_2$. In vitro passage 12 was used for subcutaneous injection at a viability of 97%. 50 microliters cell suspension ($1 \times 10^6$ MKN45 cells) mixed with 50 microliters Matrigel were injected subcutaneously in the flank of anaesthetized mice with a 22G to 30G needle.

Female NSG mice, age 4-5 weeks at start of the experiment (Jackson Laboratory) were maintained under specific-pathogen-free condition with daily cycles of 12 h light/12 h darkness according to committed guidelines (GV-Solas; Felasa; TierschG). The experimental study protocol was reviewed and approved by local government (ZH225-17). After arrival, animals were maintained for one week to get accustomed to the new environment and for observation. Continuous health monitoring was carried out on a regular basis.

Female NSG mice were injected i.p. with 15 mg/kg of Busulfan followed one day later by an i.v. injection of $1 \times 10^5$ human hematopoietic stem cells isolated from cord blood. At week 14-16 after stem cell injection mice were bled sublingual and blood was analyzed by flow cytometry for successful humanization. Efficiently engrafted mice were randomized according to their human T cell frequencies into the different treatment groups. At that time, mice were injected with tumor cells s.c. as described (FIG. 26, d0) and treated with the compounds or histidine buffer (Vehicle) when tumor size reached appr. 150 mm³ (day 13). All mice were injected i.v. with 200 µl of the appropriate solution. To obtain the proper amount of compounds per 200 µl, the stock solutions (Table 30) were diluted with histidine buffer when necessary.

TABLE 30

Compositions used in the in vivo experiment

| Compound | Formulation buffer | Concentration (mg/mL) |
|---|---|---|
| CEA-TCB | 20 mM Histidine, 140 mM NaCl, pH 6.0 | 4.82 (=stock solution) |
| CEA(T84.66)-CD28 (SA_Variant 15) | 20 mM Histidine, 140 mM NaCl, pH 6.0 | 1.71 (=stock solution) |
| CEA(A5H1EL1D)-CD28 (SA_Variant 15) | 20 mM Histidine, 140 mM NaCl, pH 6.0 | 3.89 (=stock solution) |

For combination therapies (Group C and D, FIG. 26) with CEA-CD28 and CEA-TCB the bispecific molecules were injected concomitant. Tumor growth was measured twice weekly using a caliper and tumor volume was calculated as followed:

Tv: (W²/2)×L (W: Width, L: Length)

Tumor growth inhibition values as a measurement of potency in vivo were calculated with a Roche internal statistical program as following:

$$TGI: \frac{100 - Av(T_{treatment}^{[day\,x]} - T_{treatment}^{[baseline]})}{Av(T_{Vehicle}^{[day\,x]} - T_{Vehicle}^{[baseline]})} * 100$$

The study was terminated at day 39. FIG. 27A shows the tumor growth kinetics (Mean, +SEM) as well as the individual tumor growth kinetics per group and mouse (FIGS. 27B to 27E). As described here, CEA-TCB, as a single agent induced little tumor growth inhibition. However, the combinations with both CEA-CD28 molecules showed improved tumor growth inhibition. Especially the combination of CEA-TCB with CEA-CD28 that contains the lower affinity binder for CEA (A5H1EL1D) resulted in superior tumor growth regression. As displayed in Table 31, highest TGI value (TGI: 116%) were calculated for the combination group of CEA-TCB with CEA-CD28 (huA5B7) indicating strongest anti-tumor effects. TGI means tumor growth inhibition. TGI>100 means tumor regression and TGI=100 is defined as tumor stasis.

TABLE 31

TGI at study day 39 (Vehicle as Control Group)

| Group | TGI |
|---|---|
| CEA TCB | 69 |
| CEA TCB + CEA(T84.66)-CD28 (SA_Variant 15) | 89 |
| CEA TCB + CEA(A5H1EL1D)-CD28 (SA_Variant 15) | 116 |

13.2 Efficacy Study with CEA-CD28 Bispecific Antigen Binding Molecules with Three Different CD28 Antigen Binding Domains in Combination with CEACAM5-TCB and Anti-PDL1 Antibody in BXPC3 Xenograft in Humanized Mice This efficacy study was aimed to understand the impact of the affinity of the CD28 antigen binding domain of the CEA-CD28 molecules in combination with CEACAM5-TCB and anti-PD-L1 in terms of tumor regression and ImmunoPD patterns in fully humanized NSG mice. Three different affinity variants have been tested in the current study (Variant 8<Variant 15<Variant 29).

Human BXPC3 cells (human pancreatic cancer cell line) were originally obtained from ECACC (European Collection of Cell Culture) and after expansion deposited in the Roche Glycart internal cell bank. BXPC3 cells were cultured in RPMI containing 10% FCS (PAA Laboratories, Austria) with 1% Glutamax. The cells were cultured at 37° C. in a water-saturated atmosphere at 5% $CO_2$. In vitro passage 20 was used for s.c. injection at a viability >95%. 50 microliters cell suspension ($1 \times 10^6$ BXPC3 cells) mixed with 50 microliters Matrigel were injected subcutaneously in the flank of anaesthetized mice with a 22G to 30G needle.

Female NSG mice, age 4-5 weeks at start of the experiment (Jackson Laboratory) were maintained under specific-pathogen-free condition with daily cycles of 12 h light/12 h darkness according to committed guidelines (GV-Solas; Felasa; TierschG). The experimental study protocol was reviewed and approved by local government (ZH225-17). After arrival, animals were maintained for one week to get accustomed to the new environment and for observation. Continuous health monitoring was carried out on a regular basis.

Female NSG mice were injected i.p. with 15 mg/kg of Busulfan followed one day later by an i.v. injection of $1 \times 10^5$ human hematopoietic stem cells isolated from cord blood. At week 14-16 after stem cell injection mice were bled sublingual and blood was analyzed by flow cytometry for successful humanization. Efficiently engrafted mice were randomized according to their human T cell frequencies into the different treatment groups A to F. At that time, mice were injected with tumor cells s.c. as described in FIG. 28 and treated with the compounds or Histidine buffer (Vehicle) when tumor size reached appr. 150 mm$^3$ (day 20). All mice were injected i.v. with 200 μl of the appropriate solution. To obtain the proper amount of compounds per 200 μl, the stock solutions (Table 32) were diluted with Histidine buffer when necessary.

TABLE 32

Compositions used in the in vivo experiment

| Compound | Formulation buffer | Concentration (mg/mL) |
|---|---|---|
| CEACAM5-TCB | 20 mM Histidine, 140 mM NaCl, pH 6.0 | 20.5 (=stock solution) |
| anti-PD-L1 (Atezolizumab) | 20 mM Histidine, 140 mM NaCl, pH 6.0 | 60 (=stock solution) |
| CEA(A5H1EL1D)-CD28 (SA_Variant 8) | 20 mM Histidine, 140 mM NaCl, pH 6.0 | 3.78 (=stock solution) |
| CEA(A5H1EL1D)-CD28 (SA_Variant 15) | 20 mM Histidine, 140 mM NaCl, pH 6.0 | 3.89 (=stock solution) |
| CEA(A5H1EL1D)-CD28 (SA_Variant 29) | 20 mM Histidine, 140 mM NaCl, pH 6.0 | 5.01 (=stock solution) |

At termination (day 52), mice were sacrificed, tumors were removed, weighted and single cell suspensions were prepared through an enzymatic digestion with Collagenase V and DNAse for subsequent FACS-analysis. Single cells where stained for human CD45, CD3, CD8, and CD4 and analyzed at FACS BDFortessa.

FIG. 29 shows the tumor growth kinetics (Mean, +SEM) for all treatment groups, the corresponding TGI values of each treatment arm are shown in Table 33 below. As described here, CEACAM5 TCB monotherapy as well as the combination with a-PD-L1 induced little tumor growth inhibition. Only the addition of CEA-CD28 (SA_Variant 8) to the combination of CEACAM5-TCB and a-PD-L1 led to an increased tumor growth inhibition (TGI: 75%). Neither variant 15 nor variant 29 increased the anti-tumor effects. Interestingly, the Immuno-PD data (FIGS. 30A-D) of tumors from animals sacrificed at study termination, revealed that the additional tumor growth inhibition induced by CEA-CD28 variant 8 is also reflected by an increased intratumor T cell frequency. FIG. 30A shows representative dot plots of the stained tumor single cell suspensions of each treatment arm. The summary of CD3, CD8 and CD4 T cell infiltration is depicted in FIGS. 30B, 30C and 30D, respectively. No statistical differences were observed in the groups treated with CEA-CD28 (SA_Variant 15) or CEA-CD28 (SA_Variant 29) as compared the only CEACAM5-TCB or combination with a-PD-L1 in terms of T cell infiltration in the tumor. The strongest ImmunoPD effects have been detected with CEA-CD28 (SA_Variant 8).

TABLE 33

TGI at study day 52 (Vehicle as Control Group)

| Group | TGI |
|---|---|
| CEACAM5 TCB | 35 |
| CEACAM5 TCB + a-PD-L1 | 17 |
| CEACAM5 TCB + a-PD-L1 + CEA(A5H1EL1D)-CD28 (SA_Variant 8) | 75 |
| CEACAM5 TCB + a-PD-L1 + CEA(A5H1EL1D)-CD28 (SA_Variant 15) | 37 |
| CEACAM5 TCB + a-PD-L1 + CEA(A5H1EL1D)-CD28 (SA_Variant 29) | 35 |

13.3 Efficacy Study with CEA-CD28 Bispecific Antigen Binding Molecule in Combination with CEA TCB in MKN45 Xenograft in Humanized NSG Mice The efficacy study described herein was aimed to study the combination of CEA-TCB and CEA-CD28 (SA_Variant 8) in a second human Xenograft model in terms of tumor regression and ImmunoPD patterns in fully humanized NSG mice.

Human MKN45 cells (human gastric carcinoma) were originally obtained from ATCC and after expansion deposited in the Glycart internal cell bank. Cells were cultured in DMEM containing 10% FCS at 37° C. in a water-saturated atmosphere at 5% $CO_2$. In vitro passage 12 was used for subcutaneous injection at a viability of >95%. 50 microliters cell suspension ($1\times10^6$ MKN45 cells) mixed with 50 microliters Matrigel were injected subcutaneously in the flank of anaesthetized mice with a 22G to 30G needle. Female NSG mice, age 4-5 weeks at start of the experiment (Jackson Laboratory) were maintained under specific-pathogen-free condition with daily cycles of 12 h light/12 h darkness according to committed guidelines (GV-Solas; Felasa; TierschG). The experimental study protocol was reviewed and approved by local government (ZH225-17). After arrival, animals were maintained for one week to get accustomed to the new environment and for observation. Continuous health monitoring was carried out on a regular basis.

Female NSG mice were injected i.p. with 15 mg/kg of Busulfan followed one day later by an i.v. injection of $1\times10^5$ human hematopoietic stem cells isolated from cord blood. At week 14-16 after stem cell injection mice were bled sublingual and blood was analyzed by flow cytometry for successful humanization. Efficiently engrafted mice were randomized according to their human T cell frequencies into the different treatment groups. At that time, mice were injected with tumor cells s.c. as described in FIG. 31 and treated with the molecules or Histidine buffer (Vehicle) when tumor size reached appr. 150 mm$^3$ (day 13). All mice were injected i.v. with 200 μl of the appropriate solution. To obtain the proper amount of compounds per 200 μl, the stock solutions (Table 34) were diluted with Histidine buffer when necessary.

TABLE 34

Compositions used in the in vivo experiment

| Compound | Formulation buffer | Concentration (mg/mL) |
|---|---|---|
| CEA-TCB | 20 mM Histidine, 140 mM NaCl, pH 6.0 | 4.82 (=stock solution) |
| CEA(A5H1EL1D)-CD28 (SA_Variant 8) | 20 mM Histidine, 140 mM NaCl, pH 6.0 | 3.78 (=stock solution) |

TABLE 34-continued

Compositions used in the in vivo experiment

| Compound | Formulation buffer | Concentration (mg/mL) |
|---|---|---|

For the combination therapy (Group C, FIG. 31) constructs were injected concomitant. Tumor growth was measured twice weekly using a caliper and tumor volume was calculated as followed:

Tv: $(W^2/2) \times L$ (W: Width, L: Length)

Tumor growth inhibition (TGI) values as a measurement of potency in vivo were calculated with a Roche internal statistical program as described in Example 12.1 before.

At termination (day 48), mice were sacrificed, tumors were removed, weighted and single cell suspensions were prepared through an enzymatic digestion with Collagenase V and DNAse for subsequent FACS-analysis. Single cells were stained for human CD45 and CD3 and analyzed at FACS BDFortessa.

FIG. 32 shows the tumor growth kinetics (Mean, +SEM) for all treatment groups, the corresponding TGI values of each treatment arm are shown in Table 35 below. As described here, CEA-TCB monotherapy induced tumor growth inhibition with a TGI value of 84%. However, the combination treatment with CEA-CD28 (SA_Variant 8) led to a superior tumor growth inhibition (TGI: 101%). Furthermore, the Immuno-PD data (FIG. 3) of tumors from animals sacrificed at study termination, revealed that the strong tumor growth inhibition induced by CEA-CD28 (SA_Variant 8) in combination with CEA-TCB is also reflected by an increased intratumoral T cell frequency. FIG. 33A shows representative dot plots of the stained tumor single cell suspensions of each treatment arm. The summary of CD3+ T cell infiltration is depicted in FIG. 33B.

TABLE 35

TGI at study day 48 (Vehicle as Control Group)

| Group | TGI |
|---|---|
| CEA TCB | 84 |
| CEA TCB + CEA(A5H1EL1D)-CD28 (SA_Variant 8) | 10 |

Example 14

Generation and Production of Bispecific Antigen Binding Molecules Targeting CD28 and Epithelial Cell Adhesion Molecule (EpCAM), HER3, CD30 or Trophoblast Glycoprotein (TPBG)

14.1 Cloning of Bispecific Antigen Binding Molecules Targeting CD28 and EpCAM, HER3, CD30 or TPBG For the generation of the expression plasmids, the sequences of the respective variable domains were used and sub-cloned in frame with the respective constant regions which are pre-inserted in the respective recipient mammalian expression vector. In the Fc domain, Pro329Gly, Leu234Ala and Leu235Ala mutations (PG-LALA) have been introduced in the constant region of the human IgG1 heavy chains to abrogate binding to Fc gamma receptors according to the method described in International Patent Appl. Publ. No. WO 2012/130831. For the generation of bispecific antibodies, Fc fragments contained either the "knob" (S354C/T366W mutations, numbering according to Kabat EU index) or "hole" mutations (Y349C/T366S/L368A/Y407V mutations according to Kabat EU index) to avoid mispairing of the heavy chains. In order to avoid mispairing of light chains in the bispecific antigen binding molecules, exchange of VH/VL or CH1/Ckappa domains was introduced in one binding moiety (CrossFab technology). In another binding moiety, charges were introduced into the CH1 and Ckappa domains as described in International Patent Appl. Publ. No. WO 2015/150447.

The generation and preparation of anti-EpCAM antibody MT201 (adecatumumab) is described in U.S. Pat. No. 7,632,925 B2. The production of the anti-HER3 antibody (lumretuzumab) is described in WO 2011/076683 A1. Anti-CD30 antibody brentuximab is disclosed in WO 02/34661 A2. The generation and preparation of anti-TPBG antibodies, e.g. FAB091, is described in WO 2017/072207 A1.

The following molecules were cloned, a schematic illustration thereof is shown in FIGS. 34A to 34D:

Molecule 14A: EpCAM (MT201)-CD28 (SA_Variant 15) 1+1 format, bispecific huIgG1 PG-LALA CrossFab molecule with VH/VL exchange in the CD28(SA_Variant 15) Fab fragment (knob) and charged modifications in the EpCAM (MT201) Fab fragment (hole) (FIG. 34A) comprising the amino acid sequences of SEQ ID Nos: 366, 367, 390 and 391 (P1AE9051).

Molecule 14B: HER3(lumretuzumab)-CD28 (SA_Variant 15) 1+1 format, bispecific huIgG1 PG-LALA CrossFab molecule with charged modifications in the CD28(SA_Variant 15) Fab fragment (knob) and VH/VL exchange in the anti-HER3 Fab fragment (hole) (FIG. 34B) comprising the amino acid sequences of SEQ ID Nos: 357, 358, 392 and 393 (P1AF0151).

Molecule 14C: CD30(brentuximab)-CD28 (SA_Variant 15) 1+1 format, bispecific huIgG1 PG-LALA CrossFab molecule with charged modifications in the CD28(SA_Variant 15) Fab fragment (knob) and VH/VL exchange in the anti-CD30 Fab fragment (hole) (FIG. 34C) comprising the amino acid sequences of SEQ ID Nos: 357, 358, 394 and 395 (P1AF1751).

Molecule 14D: TPBG(FAB091)-CD28 (SA_Variant 15) 1+1 format, bispecific huIgG1 PG-LALA CrossFab molecule with charged modifications in the CD28(SA_Variant 15) Fab fragment (knob) and VH/VL exchange in the anti-TPBG Fab fragment (hole) (FIG. 34D) comprising the amino acid sequences of SEQ ID Nos: 357, 358, 396 and 397 (P1AF1752).

14.2 Production of the Molecules

Expression of the above-mentioned molecules is either driven by a chimeric MPSV promoter or a CMV promoter. Polyadenylation is driven by a synthetic polyA signal sequence located at the 3' end of the CDS. In addition, each vector contains an EBV OriP sequence for autosomal replication.

Antibodies and bispecific antibodies were generated by transient transfection of HEK293 EBNA cells or CHO EBNA cells. Cells were centrifuged and, medium was replaced by pre-warmed CD CHO medium (Thermo Fisher, Cat N° 10743029). Expression vectors were mixed in CD CHO medium, PEI (Polyethylenimine, Polysciences, Inc, Cat N° 23966-1) was added, the solution vortexed and incubated for 10 minutes at room temperature. Afterwards, cells (2 Mio/ml) were mixed with the vector/PEI solution, transferred to a flask and incubated for 3 hours at 37° C. in a shaking incubator with a 5% $CO_2$ atmosphere. After the incubation, Excell medium with supplements (80% of total volume) was added (W. Zhou and A. Kantardjieff, Mammalian Cell Cultures for Biologics Manufacturing, DOI: 10.1007/978-3-642-54050-9; 2014). One day after transfection, supplements (Feed, 12% of total volume) were added. Cell supernatants were harvested after 7 days by centrifugation and subsequent filtration (0.2 µm filter), and proteins were purified from the harvested supernatant by standard methods as indicated below.

14.3 Purification of the Molecules

Proteins were purified from filtered cell culture supernatants referring to standard protocols. In brief, Fc containing proteins were purified from cell culture supernatants by Protein A-affinity chromatography (equilibration buffer: 20 mM sodium citrate, 20 mM sodium phosphate, pH 7.5; elution buffer: 20 mM sodium citrate, pH 3.0). Elution was achieved at pH 3.0 followed by immediate pH neutralization of the sample. The protein was concentrated by centrifugation (Millipore Amicon® ULTRA-15 (Art.Nr.: UFC903096), and aggregated protein was separated from monomeric protein by size exclusion chromatography in 20 mM histidine, 140 mM sodium chloride, pH 6.0.

14.4 Analytical Data of Bispecific CD28 Antigen Binding Molecules

The concentrations of purified proteins were determined by measuring the absorption at 280 nm using the mass extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII (Perkin Elmer). Determination of the aggregate content was performed by HPLC chromatography at 25° C. using analytical size-exclusion column (TSKgel G3000 SW XL or UP-SW3000) equilibrated in running buffer (25 mM $K_2HPO_4$, 125 mM NaCl, 200 mM L-Arginine Monohydrocloride, pH 6.7 or 200 mM $KH_2PO_4$, 250 mM KCl pH 6.2 respectively). A summary of the purification parameters of all molecules is given in Table 36.

TABLE 36

Summary of the production and purification of CD28 antigen binding molecules 13A to 13D

| Molecule | Description | Yield [mg/l] | Analytical SEC (HMW/ Monomer/ LMW) [%] | Purity measured by CE-SDS [%] |
|---|---|---|---|---|
| 14A | EPCAM (MT201)-CD28 (SA_Variant 15) 1 + 1 | 34.6 | 8.28/91.72/0 | 94.24 |
| 14B | HER3 (Lumretuzumab)-CD28 (SA_Variant 15) 1 + 1 | 60.3 | 0.14/99.65/0.21 | 98.53 |
| 14C | CD30 (Brentuximab)-CD28 (SA_Variant 15) 1 + 1 | 24.4 | 0/99.45/0.5 | 94.06 |
| 14D | TPBG (5T4)-CD28 (SA_Variant 15) 1 + 1 | 17.5 | 0/92.6/7.4 | 98.12 |

Example 15

In Vitro Functional Characterization of Bispecific Antigen Binding Molecules Targeting CD28 and EpCAM, HER3, CD30 or TPBG 15.1 Binding of EpCAM-CD28 to EpCAM- and CD28-Expressing Cells The binding of EpCAM-CD28 (Molecule 14A) carrying the intermediate affinity CD28 Clone Variant 15 (P1AE9051) to EpCAM was tested using HT-29 cells (ATCC #HTB-38) and the binding to human CD28 was tested with CHO cells expressing human CD28 (parental cell line CHO-k1 ATCC #CCL-61, modified to stably over-express human CD28).

To assess binding, cells were harvested, counted, checked for viability and re-suspended at 0.5 Mio cells/nil in FACS buffer (eBioscience, Cat No 00-4222-26). 5E4 cells were incubated in round-bottom 96-well plates for 1 h at 4° C. with increasing concentrations of the EpCAM-CD28 construct (10 pM-500 nM). Then, cells were washed twice with cold FACS buffer, incubated for further 30 min at 4° C. with PE-conjugated, goat-anti human PE (Jackson ImmunoReserach, Cat No 109-116-098), washed twice with cold FACS buffer, centrifuged and resuspended in 85 ul FACS buffer with DAPI (Roche, Cat No 10236276001) diluted 1:10000. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism7.

In vitro cell binding assays verify that the EpCAM-CD28 (P1AE9051) bispecific agonistic antibody binds to human CD28 (FIG. 35A) as well as to human EpCAM on HT-29 cells (FIG. 35B) in a concentration dependent manner. As expected, no binding was detected with the anti-DP47 IgG, indicating that the detection of binding is due to specific CD28 and EpCAM binding by the respective targeting moieties.

15.2 In Vitro Functional Characterization of EpCAM-CD28 Molecule Based on IL-2 Reporter Assay To assess the ability of EpCAM-CD28 (Molecule 14A) to support anti-CD3-mediated T cell activation, IL-2 reporter cells (Promega, Ca No J1651) served as effector cells (Jurkat T cell line that expresses a luciferase reporter driven by the IL-2 promoter) and HT-29 served as tumor targets. 1E4 tumor target cells were incubated in white flat-bottom 96-well plates for 6 h at 37° C. with 5E4 IL-2 reporter cells (E:T 5:1) in presence of 10 nM anti-CD3 (eBioscience #16-0037-85) alone or in combination with increasing concentrations of the EpCAM-CD28 construct (24 pM-100 nM). Prior to the measurement, plates were incubated at room temperature for 15 min, and then 100 ?al of substrate (ONE-Glo solution, Promega, Ca No E6120) was added to the cells. After 10 min of incubation at room temperature in the dark, luminescence (counts/sec) was measured with a Tecan Spark 10M.

T cell activation in combination with a constant, suboptimal anti-CD3 stimulus was assessed. To this end, IL-2 reporter Jurkat cells were co-cultured with EpCAM-expressing HT29 cells for 6 h in presence of increasing concentrations of EpCAM-CD28 (P1AE9051) and fixed, limiting concentration of anti-CD3 IgG clone OKT3 (10 nM). As depicted in FIG. 35C, EpCAM-CD28 was able to enhance T cell activation, as judged by increased IL-2 production in T cells exposed to suboptimal CD3 stimulation in a concentration dependent manner.

15.3 Binding of HER3-CD28 to HER3- and CD28-Expressing Cells

The binding of HER3-CD28 (Molecule 14B) carrying the intermediate affinity CD28 clone Variant 15 (P1AF0151) to HER3 was tested using T-47D cells (ATCC #HTB-133) and the binding to human CD28 was tested with CHO cells expressing human CD28 (parental cell line CHO-kl ATCC #CCL-61, modified to stably overexpress human CD28).

To assess binding, cells were harvested, counted, checked for viability and re-suspended at 0.5 Mio cells/ml in FACS buffer (eBioscience, Cat No 00-4222-26). 5E4 cells were incubated in round-bottom 96-well plates for 1 h at 4° C. with increasing concentrations of the HER3-CD28 construct (10 pM-500 nM). Then, cells were washed twice with cold FACS buffer, incubated for further 30 min at 4° C. with PE-conjugated, goat-anti human PE (Jackson ImmunoReserach, Cat No 109-116-098), washed twice with cold FACS buffer, centrifuged and resuspended in 85 ul FACS buffer with DAPI (Roche, Cat No 10236276001) diluted 1:10000. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism7.

FACS Analysis

To assess the relative level of HER3 at the surface of T-47D, 2E5 cells were centrifuged at 480×g for 5 min and washed with PBS. Surface staining for HER3 (APC anti human, BioLegend #324708) was performed according to the supplier's indications. Cells were washed once with 150 ul/well of PBS and resuspended in 150 μl/well of PBS and analyzed using BD FACS Fortessa.

In vitro cell binding assays verify that the HER3-CD28 (Molecule 14B) bispecific agonistic antibody binds to human CD28 (FIG. 36A) as well as human HER3 (FIG. 36B) on cells in a concentration dependent manner. As expected, no binding was detected with the anti-DP47 IgG, indicating that the detection of binding is due to specific CD28 and HER3 binding by the respective targeting moieties.

15.4 In Vitro Functional Characterization of HER3-CD28 Molecule Based on IL-2 Reporter Assay To assess the ability of HER3-CD28 (Molecule 14B) to support anti-CD3-mediated T cell activation, IL-2 reporter cells (Promega, Ca No J1651) served as effector cells (Jurkat T cell line that expresses a luciferase reporter driven by the 1L-2 promoter) and T-47D served as tumor targets. 1E4 tumor target cells were incubated in white flat-bottom 96-well plates for 6 h at 37° C. with 5E4 IL-2 reporter cells (E:T 5:1) in presence of 10 nM anti-CD3 (eBioscience #16-0037-85) alone or in combination with increasing concentrations of the HER3-CD28 construct (24 pM-100 nM). Prior to the measurement, plates were incubated at room temperature for 15 min, and then 100 ul of substrate (ONE-Glo solution, Promega, Ca No E6120) was added to the cells. After 10 min of incubation at room temperature in the dark, luminescence (counts/sec) was measured with a Tecan Spark 10M.

T cell activation in combination with a constant, suboptimal anti-CD3 stimulus was assessed. To this end, IL-2 reporter Jurkat cells were co-cultured with EpCAM-expressing HT29 cells for 6 h in presence of increasing concentrations of HER3-CD28 (P1AF0151) and fixed, limiting concentration of anti-CD3 IgG clone OKT3 (10 nM). As depicted in FIG. 36C, EpCAM-CD28 was able to enhance T cell activation, i.e. IL-2 production in T cells exposed to suboptimal CD3 stimulation in a concentration dependent manner.

15.5 In Vitro Functional Characterization of TPBG-CD28 and CD30-CD28 Agonistic Antibodies in a PBMC Assay The ability of TPBG(5T4)-CD28 (Molecule 14D) and CD30-CD28 (Molecule 14C) to enhance T cell activation mediated by anti-CD3 stimulation will be assessed with primary PBMC T cells from healthy donors as effector cells and 5T4-expressing target cells such as JIMT-1, NCI-111975, NCI-N87, and Calu-1 cells, or CD30-expressing target cells such as KARPAS-299, respectively. In such an assay, 1E4 tumor target cells will be incubated in round bottom 96-well plates for 5 days at 37° C. with 1E5 (E:T 10:1) in presence of suboptimal concentration of anti-CD3 (eBioscience #16-0037-85, clone OKT3) alone or in combination with increasing concentrations of the CD28 agonistic constructs (24 pM-100 nM). Functionality of the CD28-targeted molecules will be assessed by flow cytometry, measuring T cell activation markers (CD25, CD69) and T cell proliferation (CFSE dilution).

Example 16

Generation and Production of Bispecific Antigen Binding Molecules Targeting CD28 and a Multiple Myeloma (MM) Cell Surface Antigen 16.1 Cloning of Bispecific Antigen Binding Molecules Targeting CD28 and a Multiple Myeloma (MM) Cell Surface Antigen For the generation of the expression plasmids, the sequences of the respective variable domains were used and sub-cloned in frame with the respective constant regions which are pre-inserted in the respective recipient mammalian expression vector. In the Fc domain, Pro329Gly, Leu234Ala and Leu235Ala mutations (PG-LALA) have been introduced in the constant region of the human IgG1 heavy chains to abrogate binding to Fc gamma receptors according to the method described in International Patent Appl. Publ. No. WO 2012/130831. For the generation of bispecific antibodies, Fc fragments contained either the "knob" (S354C/T366W mutations, numbering according to Kabat EU index) or "hole" mutations (Y349C/T366S/L368A/Y407V mutations according to Kabat EU index) to avoid mispairing of the heavy chains. In order to avoid mispairing of light chains in the bispecific antigen binding molecules, exchange of VH/VL or CH1/Ckappa domains was introduced in one binding moiety (CrossFab technology). In another binding moiety, charges were introduced into the CHI and Ckappa domains as described in International Patent Appl. Publ. No. WO 2015/150447.

Anti-GPRC5D antibody 5E11 is a humanized version of clone 5E11 as described in WO 2019/154890 A1. Anti-CD38 antibodies, e.g. daratumumab, are disclosed in WO 2006/99875 Al. The generation and preparation of anti-BCMA antibodies is described in WO 2016/166629 A1.

The following molecules were cloned, a schematic illustration thereof is shown in FIGS. 37A to 37C:

Molecule 16A: GPRC5D (5E11)-CD28 (SA_Variant 15) 1+1 format, bispecific huIgG1 PG-LALA CrossFab molecule with VH/VL exchange in the CD28(SA_Variant 15) Fab fragment (knob) and charged modifications in the GPRC5D (5E11) Fab fragment (hole) (FIG. 37A) comprising the amino acid sequences of SEQ ID Nos: 366, 367, 398 and 399 (P1AF1272).

Molecule 16B: GPRC5D (5E11)-CD28 (SA_Variant 8) 1+1 format, bispecific huIgG1 PG-LALA CrossFab molecule with charged modifications in the CD28(SA_Variant 15) Fab fragment (knob) and VH/VL exchange in the GPRC5D (5E11) Fab fragment (hole) (FIG. 37A) comprising the amino acid sequences of SEQ ID Nos: 364, 365, 398 and 399 (P1AF2954).

Molecule 16C: CD38 (Daratumumab)-CD28 (SA_Variant 15) 1+1 format, bispecific huIgG1 PG-LALA CrossFab molecule with charged modifications in the CD28(SA_Variant 15) Fab fragment (knob) and VH/VL exchange in the anti-CD38 Fab fragment (hole) (FIG. 37B) comprising the amino acid sequences of SEQ ID Nos: 357, 358, 400 and 401 (P1AE9038).

Molecule 16D: anti-BCMA-CD28 (SA_Variant 15) 1+1 format, bispecific huIgG1 PG-LALA CrossFab molecule with VH/VL exchange in the CD28(SA_Variant 15) Fab fragment (knob) and charged modifications in the anti-BCMA Fab fragment (hole) (FIG. 34A) comprising the amino acid sequences of SEQ ID Nos: 366, 367, 402 and 403 (P1AE9053).

16.2 Production of the Molecules

Expression of the above-mentioned molecules is either driven by a chimeric MPSV promoter or a CMV promoter. Polyadenylation is driven by a synthetic polyA signal sequence located at the 3' end of the CDS. In addition, each vector contains an EBV OriP sequence for autosomal replication.

Antibodies and bispecific antibodies were generated by transient transfection of HEK293 EBNA cells or CHO EBNA cells. Cells were centrifuged and, medium was replaced by pre-warmed CD CHO medium (Thermo Fisher, Cat N° 10743029). Expression vectors were mixed in CD CHO medium, PEI (Polyethylenimine, Polysciences, Inc, Cat N° 23966-1) was added, the solution vortexed and incubated for 10 minutes at room temperature. Afterwards, cells (2 Mio/ml) were mixed with the vector/PEI solution, transferred to a flask and incubated for 3 hours at 37° C. in a shaking incubator with a 5% $CO_2$ atmosphere. After the incubation, Excell medium with supplements (80% of total volume) was added (W. Zhou and A. Kantardjieff, Mammalian Cell Cultures for Biologics Manufacturing, DOI: 10.1007/978-3-642-54050-9; 2014). One day after transfection, supplements (Feed, 12% of total volume) were added. Cell supernatants were harvested after 7 days by centrifugation and subsequent filtration (0.2 µm filter), and proteins were purified from the harvested supernatant by standard methods as indicated below.

Alternatively, the antibodies and bispecific antibodies described herein were prepared by Evitria using their proprietary vector system with conventional (non-PCR based) cloning techniques and using suspension-adapted CHO K1 cells (originally received from ATCC and adapted to serum-free growth in suspension culture at Evitria). For the production, Evitria used its proprietary, animal-component free and serum-free media (eviGrow and eviMake2) and its proprietary transfection reagent (eviFect). Supernatant was harvested by centrifugation and subsequent filtration (0.2 µm filter) and, proteins were purified from the harvested supernatant by standard methods 16.3 Purification of the Molecules Proteins were purified from filtered cell culture supernatants referring to standard protocols. In brief, Fc containing proteins were purified from cell culture supernatants by Protein A-affinity chromatography (equilibration buffer: 20 mM sodium citrate. 20 mM sodium phosphate, pH 7.5; elution buffer: 20 mM sodium citrate, pH 3.0). Elution was achieved at pH 3.0 followed by immediate pH neutralization of the sample. The protein was concentrated by centrifugation (Millipore Amicon® ULTRA-15 (Art.Nr.: UFC903096), and aggregated protein was separated from monomeric protein by size exclusion chromatography in 20 mM histidine, 140 mM sodium chloride, pH 6.0.

16.4 Analytical Data of Bispecific CD28 Antigen Binding Molecules

The concentrations of purified proteins were determined by measuring the absorption at 280 nm using the mass extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII or LabChip GX Touch (Perkin Elmer). Determination of the aggregate content was performed by HPLC chromatography at 25° C. using analytical size-exclusion column (TSKgel G3000 SW XL or UP-SW3000) equilibrated in running buffer (25 mM $K_2HPO_4$, 125 mM NaCl, 200 mM L-Arginine Monohydrocloride, pH 6.7 or 200 mM $KH_2PO_4$, 250 mM KCl pH 6.2 respectively). A summary of the purification parameters of the molecules is given in Table 37.

TABLE 37

Summary of the production and purification of CD28 antigen binding molecules 16A to 16D

| Molecule | Description | Yield [mg/l] | Analytical SEC (HMW/Monomer/LMW) [%] | Purity measured by CE-SDS [%] |
| --- | --- | --- | --- | --- |
| 16A | GPRC5D (5E11)-CD28 (SA_Variant 15) 1 + 1 | 46.89 | 0.73/97.68/1.59 | 93.44 |
| 16B | GPRC5D (5E11)-CD28 (SA_Variant 8) 1 + 1 | 89.84 | 2.99/95.26/1.75 | 88.76 |
| 16C | CD38 (Daratumumab)-CD28 (SA_Variant 15) 1 + 1 | 56.55 | 0.29/99.71/0 | 93.96 |
| 16D | BCMA-CD28 (SA_Variant 15) 1 + 1 | 87.6 | 1.75/98.25/0 | 94.33 |

Example 17

In Vitro Functional Characterization of Bispecific Antigen Binding Molecules Targeting CD28 and a Multiple Myeloma (MM) Cell Surface Antigen 17.1 Binding of Bispecific Antigen Binding Molecules Targeting CD28 and a Multiple Myeloma (MM) Cell Surface Antigen to Cells, Over-Expressing the Indicated Target To measure the binding to GPRC5D, BCMA, CD38 or CD28 we performed FACS-based binding assay on reported multiple myeloma cell lines (Lombardi et al., Molecular characterization of human multiple myeloma cell lines by integrative genomics: insights into the biology of the disease; Genes Chromosomes Cancer. 2007, 46(3), 226-38) or CHO transfectants, that were transduced to stably overexpress either human GPRC5D or human CD28: binding to BCMA was assessed, using IM-9 cells (ATCC CCL-159), binding to CD38 was assessed, using OCI-Ly18 cells (DSMZ ACC 699), binding to GPRC5D was assessed, using CHO-hGPRC5D cells and binding to CD28 was assessed using CHO-hCD28 cells.

IM-9 and OCI-Ly18 were cultured according to the manufacturers' instructions, the stable CHO transfectants (parental cell line CHO-kl ATCC #CCL-61) were cultured in F-12K, supplemented with 10% FCS. Briefly, suspension cells were harvested, counted and checked for viability. Adherent CHO cells were detached using Cell Dissociation Buffer (Gibco), counted and checked for viability. All subsequent steps were performed at 4° C.

Cells were washed in FACS buffer once (PBS, 2% Fetal Bovine Serum; 1% 0.5m EDTA pH 8; 0.25% $NaN_3$ Sodium azide) and re-suspended in FACS buffer at 1 Mio cells per ml. 0.1 Mio cells were plated per well of a round-bottom 96-well-plate, washed with FACS buffer once more and supernatants were discarded. Cells were stained in a total volume of 50 ul per well and increasing concentrations of the indicated CD28 bispecific molecules (0.07-300 nM) for 30 minutes at 4° C. Cells were washed twice with FACS buffer and incubated for 30 min at 4° C. in a total of 25 ul per well, containing the pre-diluted secondary antibody (Alexa Fluor 488-AffiniPure F(ab')2 Fragment Goat Anti-Human IgG, Fcγ Fragment Specific (Jackson Immunoresearch, 109-546-008, diluted 1:100 in FACS buffer, respective 109-606-008 PE, Jackson Immunoresearch, diluted 1:100 in FACS buffer, as indicated). Cells were washed twice and analyzed on a BD Fortessa flow cytometer, equipped with the software FACS Diva. Binding curves and EC50 values were obtained using GraphPadPrism6.

FIGS. 38A to 38F show that all bispecific CD28 molecules are able to bind both, human CD28 (A), as well as the respective second target, namely human CD38, human BCMA or human GPRC5D in a concentration-dependent manner. Briefly, the GPRC5D-CD28 molecule has the lowest EC50 for binding to human CD28 (Table 37), but reaches lower maximal binding as compared to the other two CD28 bispecific molecules.

Both, CD38- and BCMA-targeted CD28 molecules show concentration-dependent binding to CD38 and BCMA respectively, and reach saturation in the evaluated concentration range ($EC_{50}$ binding values are summarized in Table 38). In contrast, the GPRC5D-CD28 molecule is binding in a concentration-dependent manner, but does not reach saturation in the same concentration range, indicating a lower affinity of the GPRC5D versus the CD38 or BCMA binder, included in these molecules.

TABLE 38

EC50 values (nM) for binding of the indicated bispecific CD28 molecules to either human CD28 or the respective MM target antigens, expressed on cells

| Molecule | $EC_{50}$ Binding to CD28 (nM) | $EC_{50}$ Binding to CD38/BCMA/GPRC5D (nM) |
| --- | --- | --- |
| CD38-CD28 | 26.8 | 4.3 |
| BCMA-CD28 | 9.9 | 3.96 |
| GPRC5D-CD28 (SA_variant 15) | 4.7-5.2 | not calculated |
| GPRC5D-CD28 (SA_variant 8) | 74.2 | not calculated |

17.2 In Vitro Functional Characterization Based on IL-2 Reporter Assay (Functional Characterization of T-Cell Activation)

To assess the ability of CD38-CD28, BCMA-CD28 and GPRC5D-CD28 bispecific antigen binding molecules to support TCB-mediated T cell activation, IL-2 reporter cells (Promega, Ca No J1651) were used as effector cells (Jurkat T cell line that expresses a luciferase reporter driven by the IL-2 promoter) and NCI-H929 cells, being positive for CD38, BCMA, as well as GPRC5D as tumor targets.

Briefly, $5 \times 10^3$ tumor target cells were incubated in white flat-bottom 384-well plates (353988 Falcon™ 384-Well Flat-Bottom Tissue Culture Treated Microplate) for 5 h, respective 22 h at 37° C. with $2.5 \times 10^4$ IL-2 reporter cells (E:T 5:1) in presence of 1 nM GPRC5D-TCB alone or in combination with increasing concentrations of the CD28 bispecific molecules (12.2-50 nM). Prior to the measurement, plates were incubated at room temperature for 15 min, and then 20 ul of substrate (ONE-Glo solution, Promega, Cat No E6120) was added to the cells. After 10 min of incubation at room temperature in the dark, Luminescence (counts/sec) was measured with a Tecan Spark 10M.

Figure 39A:
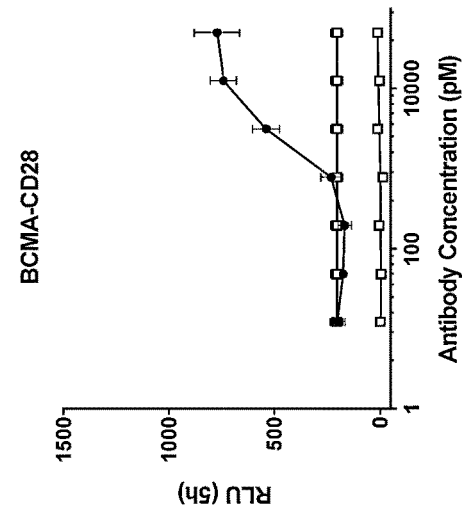
Figure 39C:
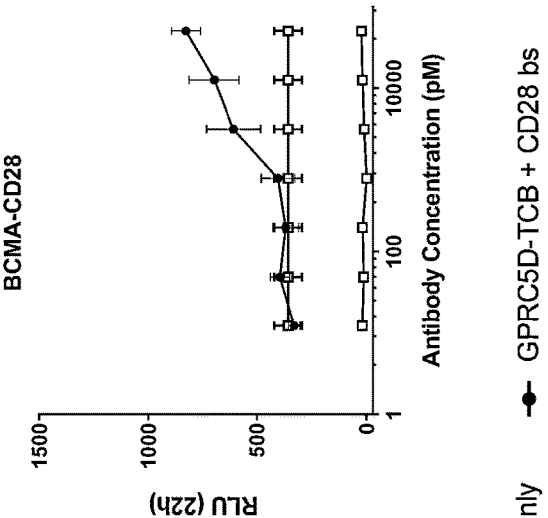
Figure 39B:
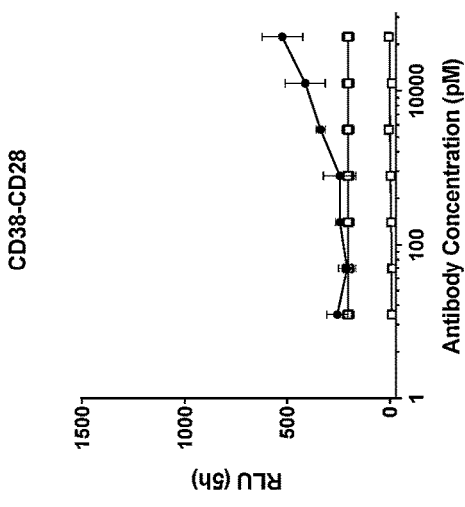
Figure 39D:
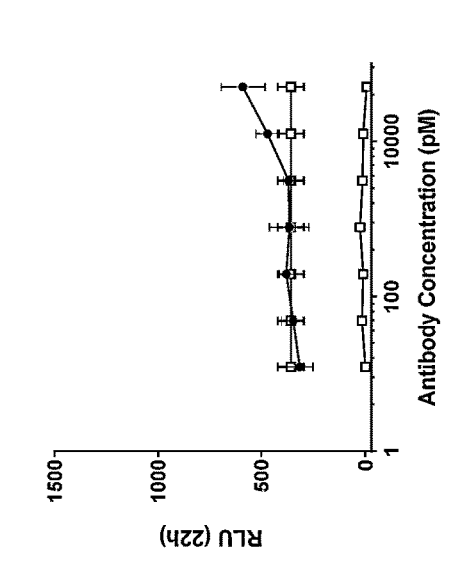
Figure 39F:
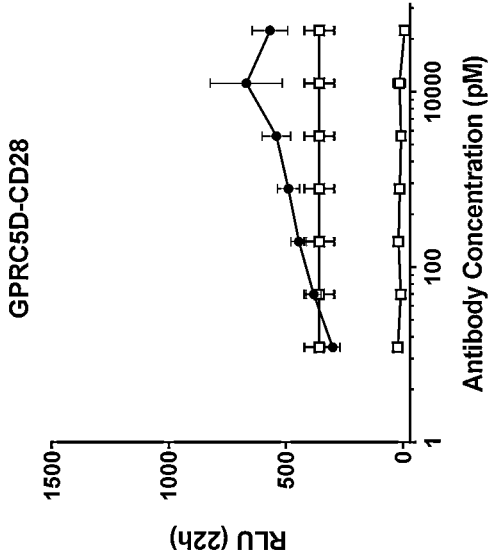
Figure 39E:
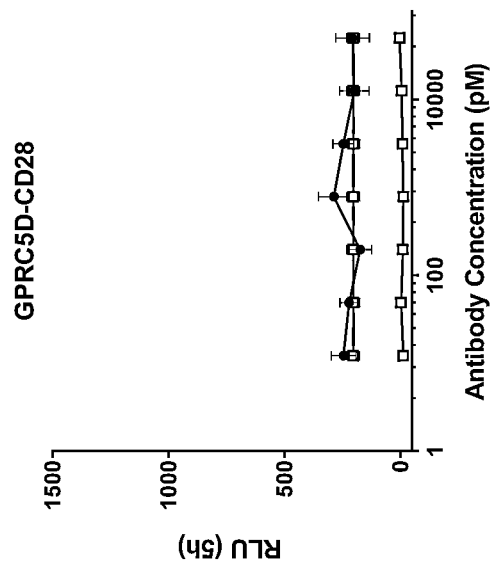

As depicted in FIGS. 39A to 39F, none of the MM-targeted CD28 molecules induces IL2 Jurkat reporter cell activation in the absence of a TCB signal (bright grey line, FIG. 39A-9F). As expected, with these IL-2 reporter cells, there is also no significant induction of reporter cell activation in the presence of 1 nM GPRC5D TCB, neither at the early timepoint (5 h), nor at the later timepoint (after 22 h).

However, all MM-targeted molecules are able to induce significant, concentration- and time-dependent activation of IL-2 reporter cells in presence of 1 nM GPRC5D-TCB. While CD38-CD28 and BCMA-CD28 molecules are able to induce IL2-reporter cell activation already after 5 h (FIGS. 39A and 39C), GPRC5D-CD28 reaches similar maximal levels of activation only at the later timepoint assessed (22 h, FIG. 39F), indicating different kinetics of activity.

The anti-GPRC5D/anti-CD3 bispecific antibody (GPRC5D TCB, FIG. 37D) used in the experiments has been prepared in analogy to CEACAM5 TCB as described in Example 8 and in WO 2016/079076 A1. GPRC5D TCB comprises the amino acid sequences of SEQ ID NO:398, SEQ ID NO:399, SEQ ID NO:404 and SEQ ID NO:405.

17.3 T-Cell Mediated lysis of Multiple Myeloma Cell Line

To assess the ability of CD38-CD28, BCMA-CD28 and GPRC5D-CD28 to boost GPRC5D TCB-mediated lysis of a Multiple Myeloma Cell line, $1.5 \times 10^5$ human pan T effector cells were incubated with $3 \times 10^4$ NCI-H929 target cells at a final E:T ratio of 1:1 for roughly 22 h. Pan T cells were isolated from PBMCs by MACS, using the Pan T cell isolation Kit (Miltenyi Biotec, Cat No 130-096-535) according to the manufacturer's instructions. GPRC5D TCB was added at increasing concentrations (0.064 pM-1 nM), the different MM-targeted bispecific CD28 antigen binding molecules were added at a fixed concentration of 0.2 nM. Tumor Cell Lysis was assessed as follows: Assay plates were centrifuged for 5 minutes and 50 ul supernatant per well were transferred into a new 96-flat-bottom-well plate. For normalization, maximal lysis of the target cells (=100%) was induced by incubation of the target cells with a final concentration of 1% Triton X-100. Minimal lysis (=0%) refers to target cells co-incubated with effector cells, but without any bispecific construct or TCB. After an overnight incubation of roughly 22 h at 37° C., 5% $CO_2$, LDH release of apoptotic/necrotic target cells into the supernatant was measured using the LDH detection kit (Roche Applied Science, #11 644 793 001), according to the manufacturer's instructions.

As illustrated in FIGS. 40a to 40C, the GPRC5D TCB induces concentration-dependent lysis of NCI-H929 cells.

All three evaluated MM-targeted bispecific CD28 antigen binding molecules are able to significantly boost efficacy compared to the TCB monotherapy, when administered at a fixed concentration of 0.2 nM. Furthermore, none of the MM-targeted bispecific CD28 antigen binding molecules is inducing tumor cell lysis in the absence of the TCB, which supports the dependency of the MM-targeted molecules on the TCB signal.

Table 39 summarizes the EC50 values, as well as area under the curve derived from the data shown in FIGS. 40A-40C. $EC_5O$ values were calculated using GraphPad-Prism6.

TABLE 39

EC50 values (nM) of anti-GPRC5D TCB mediated killing

|  | GPRC5D TCB | +CD38-CD28 | +BCMA-CD28 | +GPRC5D-CD28 |
|---|---|---|---|---|
| $EC_{50}$ lysis after 22 h (pM) | 1.86 | 3.1 | 3.7 | 3.3 |
| Area under the curve | 21.3 | 44.8 | 46.3 | 46.8 |

Example 18

Generation and Production of Bispecific Antigen Binding Molecules Targeting CD28 and CD19 or CD79b 18.1 Cloning of Bispecific Antigen Binding Molecules Targeting CD28 and CD19 or CD79b The generation and preparation of CD19 antibodies is disclosed in WO 2017/55541 A1 or WO 2017/55328 A1. In particular, the CD19 clone 2B11 is described in WO 2017/55328 A1, which is incorporated herein by reference. The CD79b clone huMA79b.v28 (corresponding to polatuzumab) as used herein is described in WO 2009/012268 A. For the generation of the respective expression plasmids, the sequences of the respective variable domains were used and sub-cloned in frame with the respective constant regions which are pre-inserted in the respective recipient mammalian expression vector. A schematic description of the resulting molecules is shown in FIGS. 41A and 41B, respectively. Pro329Gly, Leu234Ala and Leu235A1a mutations (PG-LALA) have been introduced in the constant region of the human IgG1 heavy chains to abrogate binding to Fc gamma receptors. For the generation of unsymmetric bispecific antibodies, Fc-fragments contained either the "knob" or "hole" mutations to avoid mispairing of the heavy chains. In order to avoid mispairing of light chains in bi- and multispecific antibody constructs, exchange of VH/VL or CH1/Ckappa domains was introduced in one binding moiety (CrossFab technology). In another binding moiety, charges were introduced into the CH1 and Ckappa domains.

The following molecules were cloned, a schematic illustration thereof is shown in FIGS. 41A and 41B:

Molecule 18A: CD19 (8B8-2B11)—CD28 (SA_v29) 1+1, bispecific huIgG1 PG-LALA CrossFab molecule with charge modifications in the CD28 v29 Fab (knob) and VH/VL exchange in the CD19 (2B11) Fab (hole) (FIG. 41A). The molecule comprises the heavy chain amino acid sequences of SEQ ID NOs: 118 and 430 and the light chain amino acid sequences of SEQ ID NOs:65 and 431 (P1AE8002).

Molecule 18B: CD19 (8B8-2B11)—CD28 (SA_v15) 1+1, bispecific huIgG1 PG-LALA CrossFab molecule with charge modifications in the CD28 v15 Fab (knob) and VH/VL exchange in the CD19 (2B11) Fab (hole) (FIG. 41A). The molecule comprises the heavy chain amino acid sequences of SEQ ID NOs: 116 and 430 and the light chain amino acid sequences of SEQ ID NOs:121 and 431 (P1AE9040).

Molecule 18C: CD19 (8B8-2B11)—CD28 (SA_v8) 1+1, bispecific huIgG1 PG-LALA CrossFab molecule with charge modifications in the CD28 v8 Fab (knob) and VH/VL exchange in the CD19 (2B11) Fab (hole) (FIG. 41A). The molecule comprises the heavy chain amino acid sequences of SEQ ID NOs: 114 and 430 and the light chain amino acid sequences of SEQ ID NOs:122 and 431 (P1AF0175).

Molecule D: CD19 (8B8-2B11)—CD28 (SA_v11) 1+1, bispecific huIgG1 PG-LALA CrossFab molecule with charge modifications in the CD28 v11 Fab (knob) and VH/VL exchange in the CD19 (2B11) Fab (hole) (FIG. 2B). The molecule comprises the heavy chain amino acid sequences of SEQ ID NOs: 114 and 430 and the light chain amino acid sequences of SEQ ID NOs:65 and 431 (P1AF0377).

Molecule E: CD19 (8B8-2B11)—CD28 (SA_v27) 1+1, bispecific huIgG1 PG-LALA CrossFab molecule with charge modifications in the CD28 v27 Fab (knob) and VH/VL exchange in the CD19 (2B11) Fab (hole) (FIG. 2B). The molecule comprises the heavy chain amino acid sequences of SEQ ID NOs: 118 and 430 and the light chain amino acid sequences of SEQ ID NOs:123 and 431 (P1AF0378).

Molecule F: CD79b (huMA79b.v28)—CD28 (SA_v15) 1+1, bispecific huIgG1 PG-LALA CrossFab molecule with charge modifications in the CD28 v15 Fab (knob) and VH/VL exchange in the CD79b (huMA79b.v28) Fab (hole) (FIG. 2C). The molecule comprises the heavy chain amino acid sequences of SEQ ID NOs: 116 and 432 and the light chain amino acid sequences of SEQ ID NOs:121 and 433 (P1AE9039).

18.2 Production of Bispecific Antigen Binding Molecules Targeting CD28 and CD19 or CD79b Expression of the above-mentioned molecules is driven by a CMV promoter. Polyadenylation is driven by a synthetic polyA signal sequence located at the 3' end of the CDS. In addition, each vector contains an EBV OriP sequence for autosomal replication.

For the production of all constructs, HEK293-EBNA cells that grow in suspension were transiently co-transfected with the respective expression vectors using polyethylenimine as a transfection reagent. Cells were centrifuged and medium replaced by pre-warmed CD CHO medium. Expression vectors were mixed in CD CHO medium, PEI was added, the solution vortexed and incubated for 10 minutes at room temperature. Afterwards, cells were mixed with the DNA/PEI solution, transferred to shake flask and incubated for 3 hours at 37° C. in an incubator with a 5% $CO_2$ atmosphere. After the incubation, Excell medium with supplements was added (Mammalian Cell Cultures for Biologics Manufacturing, Editors: Weichang Zhou, Anne Kantardjieff). One day after transfection, supplements (Feed) were added (Mammalian Cell Cultures for Biologics Manufacturing, Editors: Weichang Zhou, Anne Kantardjieff). Cell supernatants were harvested after 7 days by centrifugation and subsequent filtration (0.2 μm filter) and purified by standard methods.

18.3 Purification of Bispecific Antigen Binding Molecules Targeting CD28 and CD19 or CD79b Proteins were purified from filtered cell culture supernatants referring to standard protocols.

In brief, Fc containing proteins were purified from cell culture supernatants by Protein A-affinity chromatography (equilibration buffer: 20 mM sodium citrate, 20 mM sodium phosphate, pH 7.5; elution buffer: 20 mM sodium citrate, pH 3.0). Elution was achieved at pH 3.0 followed by immediate pH neutralization of the sample. The protein was concentrated by centrifugation (Millipore Amicon® ULTRA-15 (Art.Nr.: UFC903096), and aggregated protein was separated from monomeric protein by size exclusion chromatography in 20 mM histidine, 140 mM sodium chloride, pH 6.0.

18.4 Analytical Data of Bispecific or Trispecific Antibodies Targeting CD28 and CD19 or CD79b The protein concentration of purified constructs was determined by measuring the optical density (OD) at 280 nm, using the mass extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII (Perkin Elmer). Determination of the aggregate content was performed by HPLC chromatography at 25° C. using analytical size-exclusion column (TSKgel G3000 SW XL or UP-SW3000) equilibrated in running buffer (25 mM $K_2HPO_4$, 125 mM NaCl, 200 mM L-Arginine Monohydrocloride, pH 6.7 or 200 mM $KH_2PO_4$, 250 mM KCl pH 6.2 respectively). A summary of the purification parameters of all molecules is given in Table 40.

TABLE 40

Summary of the production and purification of bispecific CD28 antigen binding molecules

| Molecule | Description | Yield [mg/l] | Analytical SEC (HMW/ Monomer/ LMW) [%] | Purity measured by CE-SDS [%] |
|---|---|---|---|---|
| 18A | CD19 (2B11)-CD28 (v29) 1 + 1 | 24.9 | 1.45/98.55/0 | 96.25 |
| 18B | CD19 (2B11)-CD28 (v15) 1 + 1 | 45.05 | 0/99.1/0.9 | 98.78 |
| 18C | CD19 (2B11)-CD28 (v8) 1 + 1 | 22.06 | 2.08/96.67/1.25 | 93.11 |
| 18D | CD19 (2B11)-CD28 (v11) 1 + 1 | 40.9 | 0/98.9/1.1 | 97.1 |
| 18E | CD19 (2B11)-CD28 (v27) 1 + 1 | 41.7 | 0.49/98.9/0.61 | 90.9 |
| 18F | CD79b (huMA79b.v28)-CD28(v15) 1 + 1 | 20.6 | 1.31/98.34/0.35 | 94.43 |

Example 19

Binding and Kinetic Analysis of Bispecific Antigen Binding Molecules Targeting CD28 and CD19 or CD79b 19.1 Kinetic Analysis of Bispecific Antigen Binding Molecules Targeting CD79b Affinity ($K_D$) of huMA79b.v28 to recombinant CD79b-His (Sinobiological #29750-H08H) was measured by SPR by surface plasmon resonance using a Biacore T200 machine. For the capture of CD79b-His, an anti-penta HIS antibody was coupled to a flow cell of a CM5 chip by amine coupling. Immobilization levels of approx. 5000 units were used. CD79b-His was then diluted to a concentration of 1 nM and was captured by the anti-penta HIS antibody during 10s at a flow rate of 10 µl/min.

For the determination of the affinity ($K_D$) of the purified Molecule F (CD79b (huMA79b.v28)—CD28 (SA_variant 15) 1+1) a two-fold dilution series of the purified antigen binding molecule (varying concentration ranges between 125 and 0.49 nM) were injected at 30 µl/min with an association time of 180s, and a dissociation time of 400s. HBS-EP buffer (GE-Healthcare standard buffer BR-1006-69 1:10 diluted) was injected for referencing. Regeneration was performed with 10 mM glycine pH 2.1 for 2×60 s. Association rate constants ($k_{on}$) and dissociation rate constants ($k_{off}$) were calculated using a simple one-to-one Langmuir binding model by simultaneously fitting the association and dissociation sensorgrams (FIG. 42). The equilibrium dissociation constant (KD) was calculated as the ratio $k_{off}/k_{on}$. The results are shown in Table 41. The affinity of Molecule F (CD79b (huMA79b.v28)—CD28 (SA_variant 15) 1+1) to CD79b-His is 76 nM.

TABLE 41

Characterization of the binding of huMA79b.v28 to recombinant soluble CD79b-His

| clone | k on (1/Ms) | k off (1/s) | $K_D$ (nM) |
|---|---|---|---|
| huMA79b.v28 | 2.57E+5 | 1.95E−2 | 76 |

19.2 Kinetic Analysis of Bispecific Antigen Binding Molecules Targeting CD28

Affinity ($K_D$) of the produced bispecific antigen binding molecules to CD28 was measured by SPR using a ProteOn XPR36 instrument (Biorad) at 25° C. with biotinylated huCD28-Fc antigen immobilized on NLC chips by neutravidin capture. Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of about 200, 400 or 800 response units (RU) in vertical orientation. Injection of analytes: For one-shot kinetics measurements, injection direction was changed to horizontal orientation, two-fold dilution series of purified bispecific CD19-targeted anti-CD28 affinity variants (varying concentration ranges between 50 and 3.125 nM) were injected simultaneously at 50 µl/min along separate channels 1-5, with association times of 150s, and dissociation times of 450s. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant ($K_D$) was calculated as the ratio $k_{off}/k_{on}$. Analyzed clones revealed $K_D$ values in a broad range (between 1 and 50 nM).

Example 20

Binding of Bispecific CD28 Agonistic Antigen Binding Molecules to CD28-Expressing and CD19- or CD79b-Expressing Cells Binding to human CD28 was tested with CHO cells expressing human CD28 (parental cell line CHO-kl ATCC

CCL-61, modified to stably overexpress human CD28). To assess binding, cells were harvested, counted, checked for viability and re-suspended at 2.5×10$^5$/ml in FACS buffer (eBioscience, Cat No 00-4222-26). 5×10$^4$ cells were incubated in round-bottom 96-well plates for 2 h at 4° C. with increasing concentrations of the CD28 binders (1 pM-100 nM). Then, cells were washed three times with cold FACS buffer, incubated for further 60 min at 4° C. with PE-conjugated, goat-anti human PE (Jackson ImmunoReserach, Cat No 109-116-098), washed once with cold FACS buffer, centrifuged and resuspended in 100 ul FACS buffer. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism6.

The monovalent one-armed IgG-like CD28 variant constructs showed differences in binding as can be seen from FIGS. 4A to 4C.

The binding to CD19 and CD79b was tested using B cell lines expressing different levels of CD19 and CD79b: Nalm6 (DSMZ #ACC 128), RCK8 (DSMZ #ACC 561), WSU DLCL2 (DSMZ #ACC 575) and Z138 (gift from M. Dyer, Univ. of Leicester).

To assess binding, cells were harvested, counted, checked for viability and re-suspended at 0.5 Mio cells/ml in FACS buffer (eBioscience, Cat No 00-4222-26). 5E4 cells were incubated in round-bottom 96-well plates for 1 h at 4° C. with increasing concentrations of the CD19-CD28 (or CD79b-CD28) constructs (10 pM-500 nM). Then, cells were washed twice with cold FACS buffer, incubated for further 30 min at 4° C. with PE-conjugated, goat-anti human PE (Jackson ImmunoReserach, Cat No 109-116-098), washed twice with cold FACS buffer, centrifuged and resuspended in 85 ul FACS buffer with DAPI (Roche, Cat No 10236276001) diluted 1:10000. To monitor unspecific binding interactions between constructs and cells, an anti-DP47 IgG was included as negative control. Binding was assessed by flow cytometry with a FACS Fortessa (BD, Software FACS Diva). Binding curves were obtained using GraphPadPrism7. A comparison of the binding of CD19-CD28 v15 to the different B cell lines is shown in FIGS. 43A and 43B.

FACS Analysis

To assess the relative level of CD19 at the surface of B cell lines (Nalm6, RCK8, WSU DLCL2 and Z138), cells were Fc-blocked prior to the staining using Human Fc Block (BD, Cat No 564220), then 2×10$^5$ cells were centrifuged at 480×g for 5 min and washed with PBS. Surface staining for CD19 (BV650 anti human, BioLegend #302238) was performed according to the supplier's indications. Cells were washed once with 150 μl/well of PBS and resuspended in 150 μl/well of PBS and analyzed using BD FACS Fortessa.

In vitro cell binding assays verified that all CD19-CD28 agonistic antibodies bind to human CD19 as well as human CD28 on cells in a concentration dependent manner (FIGS. 44A and 44B). As expected, no binding was detected with the anti-DP47 IgG, indicating that the detection of binding is due to specific CD28 and CD19 binding by the respective targeting moieties. The EC$_{50}$ values for the binding to CD28 are shown in Table 42 and the EC$_{50}$ values for the binding to CD19 are shown in Table 43.

TABLE 42

EC$_{50}$ values of CD19-CD28 agonistic antibodies for binding to CD28

| ID | Molecules | EC$_{50}$ (nM) |
|---|---|---|
| P1AF0175 | CD19-CD28 v8 | 232 |
| P1AF0377 | CD19-CD28 v11 | 150.4 |
| P1AE9040 | CD19-CD28 v15 | 15.55 |
| P1AF0378 | CD19-CD28 v27 | 10.75 |
| P1AE8002 | CD19-CD28 v29 | 6.646 |

TABLE 43

EC$_{50}$ values of CD19-CD28 agonistic antibodies for binding to CD19

| ID | Molecules | EC$_{50}$ (nM) |
|---|---|---|
| P1AF0175 | CD19-CD28 v8 | 0.2324 |
| P1AF0377 | CD19-CD28 v11 | 0.3631 |
| P1AE9040 | CD19-CD28 v15 | 0.416 |
| P1AF0378 | CD19-CD28 v27 | 0.368 |
| P1AE8002 | CD19-CD28 v29 | 0.2742 |

Example 21

In Vitro Functional Characterization of Bispecific CD28 Agonistic Antigen Binding Molecules Targeting CD19 or CD79b Several cell-based in vitro assays were performed with primary human PBMCs to evaluate the activity of CD28 (SA) and bispecific CD19 or CD79b-targeted CD28 antigen binding molecules in the presence and absence of TCR signals provided by T-cell bispecific-(TCB) antibodies. T-cell proliferation, cytokine secretion, and tumor cell killing as determined by flow cytometry, cytokine ELISA, and live cell imaging were obtained as read-outs.

PBMC Isolation

Peripheral blood mononuclear cells (PBMCs) were prepared by density gradient centrifugation from enriched lymphocyte preparations of heparinized blood obtained from a Buffy Coat (Blutspende Zurich). 25 ml of blood (diluted 1:2 in PBS) were layered over 15 ml lymphoprep (STEMCELL technologies, Cat No 07851) and centrifuged at room temperature for 25 min at 845×g without brake. The PBMC-containing interphase was collected in 50 ml tubes with a 10 ml pipette. The cells were washed with PBS and centrifuged 5 min at 611×g. The supernatant was discarded, the pellet re-suspended in 50 ml PBS and centrifuged for 5 min at 304×g. The washing step was repeated, centrifuging at 171×g. The cells were re-suspended in RPMI 1640 Glutamax (containing 5% human serum, sodium pyruvate, NEAA, 50 μM 2-mercaptoethanol, Penicillin/Streptomycin) and processed for further functional analysis according to the respective assay protocol.

In Vitro Functional Characterization of CD19-CD28 and CD79b-CD28 Molecules Based on IL-2 Reporter Assay To assess the ability of CD19-CD28 and CD79b-CD28 to support TCB-mediated T cell activation, IL-2 reporter cells (Promega, Ca No J1651) served as effector cells (Jurkat T cell line that expresses a luciferase reporter driven by the IL-2 promoter) and Nalm6, RCK8, WSU DLCL2 and Z138 served as tumor targets. 2×10$^4$ tumor target cells were incubated in white flat-bottom 96-well plates for 6 h at 37° C. with 10$^5$ IL-2 reporter cells (E:T 5:1) in presence of suboptimal CD20-TCB (P1AD4071) concentrations (10 nM for Nalm6 or 0.05 nM for RCK8, WSU DLCL2 and Z138) alone or in combination with increasing concentrations of the CD19-CD28 (or CD79b-CD28) constructs (0.2 pM-10 nM). Prior to the measurement, plates were incubated at room temperature for 15 min, and then 100 ul of substrate (ONE-Glo solution, Promega, Cat No E6120) was added to the cells. After 10 min of incubation at room temperature in the dark, Luminescence (counts/sec) was measured with a Tecan Spark 10M.

In Vitro Functional Characterization of CD19-CD28 Based on PBMC-Isolated T Cell Activation To assess the ability of CD19-CD28 to support TCB-mediated T cell activation, pan T cells were used as effector cells and isolated from PBMCs by MACS, using the Pan T Cell Isolation Kit (Miltenyi Biotec, Cat No 130-096-535) according to the manufacturer's instructions and Nalm6, RCK8, WSU DLCL2 and Z138 served as tumor targets. $2 \times 10^4$ tumor target cells were incubated in flat-bottom 96-well plates for 48 h at 37° C. with $10^5$ pan T cells (E:T 5:1) in presence of suboptimal CD20-TCB (P1AD4071) concentrations (10 nM for Nalm6 or 0.05 nM for RCK8, WSU DLCL2 and Z138) alone or in combination with increasing concentrations of the CD19-CD28 constructs (0.2 pM-10 nM). T cell activation was assessed via flow cytometry. Briefly, cells were centrifuged at 480×g for 5 min and washed with PBS. Surface staining for CD8 (BV421 anti human, BioLegend #301036), CD4 (PE-Cy7 anti human, BioLegend #344611), CD25 (BV605 anti human, BioLegend #302632), CD69 (PE anti human, BioLegend #310906) was performed according to the supplier's indications. Cells were washed once with 150 ul/well of PBS and resuspended in 150 ul/well of PBS and analyzed using BD FACS Fortessa.

Cytokine Release Assessment

To assess the ability of CD19-CD28 to trigger cytokine release in presence of TCR signaling, $5 \times 10^5$ PBMCs were incubated in U-bottom 96-well plates for 48 h at 37° C. in presence of CD19-CD28 (1 nM) and suboptimal CD20-TCB (P1AD4071) concentration (0.4 pM). To assess the ability of CD19-CD28 to trigger cytokine release in absence of TCR signaling, $5 \times 10^5$ PBMCs were incubated in U-bottom 96-well plates for 48 h at 37° C. in presence of increasing concentrations of the CD19-CD28 constructs (0.08 nM-100 nM). Cytokine release was assessed via Multiplex assay. 50 μl/well of supernatant was screened for G-CSF, GM-CSF, IFN-γ, IL-1β, IL-2, IL-4, IL-5, IL-6, IL-7, IL-8, IL-10, IL-12 (p70), IL-13, IL-17, MCP-1 (MCAF), MIP-1β and TNF-α secretion using the Bio-Plex Pro Human Cytokine 17-plex Assay (Bio-rad, Cat No m5000031yv) according to the supplier's indications.

CD19-CD28 Enhances CD20-TCB Mediated T Cell Activation on Various B Cell Lines

To assess the ability of CD19-CD28 antibodies to enhance CD20-TCB mediated effector function, T cell activation in TCB combination was assessed. To this end, IL-2 reporter Jurkat cells were co-cultured with four different CD19-expressing cell lines (Nalm6, WSU DLCL2, Z138, RCK8) for 6 h in presence of increasing concentrations of CD19-CD28 v15 (P1AE9040) and fixed, limiting concentration of CD20-TCB (P1AD4071). CD20 TCB is an anti-CD20/anti-CD3 bispecific antibody in a 2+1 format as described in Example 1 of WO 2016/020309 A1. As depicted in FIGS. 45A to 45D, CD19-CD28 increases CD20-TCB mediated effector function in presence of all four B cell lines in a concentration dependent manner.

Affinity-Reduced CD28 Binder Variants are Functional In Vitro in a CD19-CD28 Bispecific Format The original CD28(SA) clone has an affinity of $K_D$=1 nM. High affinity antibody clones harbor the risk to be subject to peripheral sink effects, especially if the target is highly expressed in peripheral blood, as is the case for CD28. In order to (i) reduce peripheral sink effects, and (ii) reduce the risk of peripheral T cell activation through off-tumor binding of targ. CD28 agonists to T cells, we generated a series of 31 CD28 clones with reduced affinities by introducing point mutations in the CDRs (see Example 1.1). Candidate clones were selected as previously described. 5 molecules with different CD28 affinities were generated in the CD19-targeted bispecific format: CD19-CD28 v8 (P1AF0175), CD19-CD28 v11 (P1AF0377), CD19-CD28 v15 (P1AE9040), CD19-CD28 v27 (P1AF0378) and CD19-CD28 v29 (P1AE8002). FIGS. 44A and 44B show that all generated CD19-CD28 molecules bind to human CD19 as well as CD28, and binding intensities correlate with binder affinities.

To assess whether affinity-reduced CD28 clone variants were functional and able to support TCB-mediated effector functions, we assessed T cell activation in TCB combination. To this end, IL-2 reporter Jurkat cells were co-cultured with CD19-expressing Nalm6 cells for 6 h in presence of increasing concentrations of CD19-CD28 and fixed, limiting concentration of CD20-TCB. As depicted in FIG. 46, all variants of the CD28 binders were functional and able to increase TCB-mediated T cell activation in a concentration dependent manner. Pan T cells were used as effector cells and isolated from PBMCs by MACS, using the Pan T Cell Isolation Kit (Miltenyi Biotec) according to the manufacturer's instructions.

CD19-CD28 does not Activate PBMC T Cells in Absence of TCR Signals

To confirm that CD19-CD28 constructs are inactive without a TCR signal such as the one provided by CD20-TCB, we assessed the activation status of PBMC-derived T cells after co-culture with CD20-expressing target cells (Nalm6) and CD19-CD28 in absence or presence of CD20-TCB. As depicted in FIG. 47, CD19-CD28 enhances CD20-TCB mediated CD69 expression in PBMC T cells in a dose-dependent manner, while in absence of TCB, CD19-CD28 does not lead to T cell activation, even at high concentrations (100 nM). This finding is confirmed by our observation that CD19-CD28 did not lead to cytokine release in PBMC derived T cells after co-incubation with CD19-CD28 v8 or CD19-CD28 v15 in presence or absence of CD20-TCB (FIGS. 48A to 48D). In conclusion, these data confirm that CD19-CD28 is not a superagonistic antibody but requires a TCR signal, i.e. provided by a TCB, to enhance T cell activation.

CD79b-CD28 Enhances CD20-TCB-Mediated T Cell Activation

In addition to CD19-targeted CD28 agonistic antibodies, we also generated CD79b-targeted CD28 antibodies to assess their ability to enhance CD20-TCB mediated T cell activation. For this, the CD79b positive B cell line Z138 was used. As shown in FIG. 49A, CD79b-CD28 binds to Z138. Further, CD79b-CD28 was able to enhance CD20-TCB-mediated IL-2 production of IL-2 Jurkat cells when incubated with Z138 in presence of 0.05 nM CD20-TCB (FIG. 49B).

Example 22

In Vivo Functional Characterization of Bispecific Antigen Binding Molecules Targeting CD28 and CD19

Efficacy Study with CD19-CD28 Bispecific Antigen Binding Molecules with Different CD28 Variants in NALM6 Xenograft in Humanized Mice The efficacy study described in here was aimed to evaluate which CD28 variant in the CD19-CD28 bispecific antigen binding molecule will lead to stronger tumor growth inhibition in monotherapy in a CD19-positive human lymphoma model in fully humanized NSG mice.

Human NALM6 cells (B cell precursor leukemia) were originally obtained from ATCC and after expansion deposited in the Glycart internal cell bank. Cells were cultured in RPMI containing 10% FCS and 1x Glutamax. The cells were cultured at 37° C. in a water-saturated atmosphere at 5% $CO_2$. 50 microliters cell suspension ($1 \times 10^6$ NALM6 cells) mixed with 50 microliters Matrigel were injected subcutaneously in the flank of anaesthetized mice with a 22G to 30G needle.

Female NSG mice, age 4-5 weeks at start of the experiment (Jackson Laboratory) were maintained under specific-pathogen-free condition with daily cycles of 12 h light/12 h darkness according to committed guidelines (GV-Solas; Felasa; TierschG). The experimental study protocol was reviewed and approved by local government (ZH225-17). After arrival, animals were maintained for one week to get accustomed to the new environment and for observation. Continuous health monitoring was carried out on a regular basis.

Female NSG mice were injected i.p. with 15 mg/kg of Busulfan followed one day later by an i.v. injection of $1 \times 10^5$ human hematopoietic stem cells isolated from cord blood. At week 14-16 after stem cell injection mice were bled sublingual and blood was analyzed by flow cytometry for successful humanization. Efficiently engrafted mice were randomized according to their human T cell frequencies into the different treatment groups. At that time, mice were injected with tumor cells s.c. as described (FIG. 50) and treated with the compounds or Histidine buffer (Vehicle) when tumor size reached appr. 150 mm³ (day 18). All mice were injected i.v. with 200 µl of the appropriate solution. To obtain the proper amount of compounds per 200 µl, the stock solutions (Table 44) were diluted with Histidine buffer when necessary.

TABLE 4

Compositions used in the in vivo experiment

| Compound | Formulation buffer | Concentration (mg/mL) |
|---|---|---|
| CD19-CD28 (variants) | 20 mM Histidine, 140 mM NaCl, pH 6.0 | 5.63 (=stock solution) |
| CD19-CD28 (variant 8) | 20 mM Histidine, 140 mM NaCl, pH 6.0 | 3.53 (=stock solution) |

Tumor growth was measured twice weekly using a caliper and tumor volume was calculated as followed:
Tv: $(W^2/2) \times L$ (W: Width, L: Length)

The study was terminated at day 53. FIG. 51A shows the tumor growth kinetics (Mean, +SEM) and FIGS. 51B to 51D show the individual tumor growth kinetics per group and mouse. As described here, CD19-CD28 variant 8, as a single agent induced stronger tumor growth inhibition as compared to CD19-CD28 variant 15. Vehicle animal had to be sacrificed earlier due to the formation of metastasis upon s.c. tumor cell injection. The monotherapeutic effect in humanized mice can be explained by the boosting of Allo-reactive human T cells, that can be seen as a surrogate for neo-antigen recognition, in the mouse system.

REFERENCES

Acuto, O., and Michel, F. (2003). CD28-mediated co-stimulation: a quantitative support for TCR signalling. Nat Rev Immunol 3, 939-951.

Atamaniuk, J., Gleiss A., Porpaczy E., Kainz B., Grunt T. W., Raderer M., Hilgarth B., Drach J., Ludwig H., Gisslinger H., Jaeger U., Gaiger A. (2012). Overexpression of G protein-coupled receptor 5D in the bone marrow is associated with poor prognosis in patients with multiple myeloma. Eur J Clin Invest. 42(9), 953-60.

Bahlis N. J., King A. M., Kolonias D. Carlson L. M., Liu H. Y., Hussein M. A., Terebelo H. R., Byrne G. E. Jr, Levine B. L., Boise L. H., Lee K. P. (2007). CD28-mediated regulation of multiple myeloma cell proliferation and survival. Blood 109 (11), 5002-5010.

Boomer, J. S., and Green, J. M. (2010). An enigmatic tail of CD28 signaling. Cold Spring Harb Perspect Biol 2, a002436.

Bräuner-Osborne H., Jensen A. A., Sheppard P. O., Brodin B., Krogsgaard-Larsen P., O'Hara P. (2001). Cloning and characterization of a human orphan family C G-protein coupled receptor GPRC5D. Biochim. Biophys. Acta 1518 (3), 237-48.

Carreno, B. M., and Collins, M. (2002). The B7 family of ligands and its receptors: new pathways for costimulation and inhibition of immune responses. Annu Rev Immunol 20, 29-53.

Chen, L., and Flies, D. B. (2013). Molecular mechanisms of T cell co-stimulation and co-inhibition. Nat Rev Immunol 13, 227-242.

Cho S. F., Anderson K. C., Tai Y. T. (2018). Targeting B Cell Maturation Antigen (BCMA) in Multiple Myeloma: Potential Uses of BCMA-Based Immunotherapy. Front Immunol. 9, 1821.

Cohen Y., Gutwein O., Garach-Jehoshua O., Bar-Haim A., Kornberg A. (2013). GPRC5D is a promising marker for monitoring the tumor load and to target multiple myeloma cells. Hematology 18(6), 348-51.

Engelhardt, J. J., Sullivan, T. J., and Allison, J. P. (2006). CTLA-4 overexpression inhibits T cell responses through a CD28-B7-dependent mechanism. J Immunol 177, 1052-1061.

Esensten, J. H., Helou, Y. A., Chopra, G., Weiss, A., and Bluestone, J. A. (2016). CD28 Costimulation: From Mechanism to Therapy. Immunity 44, 973-988.

Fraser, J. D., Irving, B. A., Crabtree, G. R., and Weiss, A. (1991). Regulation of interleukin-2 gene enhancer activity by the T cell accessory molecule CD28. Science 251, 313-316.

Gao Y., Wang X., Yan H., Zeng J., Ma S., Niu Y., Zhou G., Jiang Y., Chen Y. (2016). Comparative Transcriptome Analysis of Fetal Skin Reveals Key Genes Related to Hair Follicle Morphogenesis in Cashmere Goats. PLoS One 11(3), e0151118.

Hui, E., Cheung, J., Zhu, J., Su, X., Taylor, M. J., Wallweber, H. A., Sasmal, D. K., Huang, J., Kim, J. M., Mellman, I., and Vale, R. D. (2017). T cell costimulatory receptor CD28 is a primary target for PD-1-mediated inhibition. Science 355, 1428-1433.

Hunig, T. (2012). The storm has cleared: lessons from the CD28 superagonist TGN1412 trial. Nat Rev Immunol 12, 317-318.

Inoue, S., Nambu T. and Shimomura T. (2004). The RAIG family member, GPRC5D, is associated with hard-keratinized structures. J Invest Dermatol. 122(3), 565-73.

June, C. H., Ledbetter, J. A., Gillespie, M. M., Lindsten, T., and Thompson, C. B. (1987). T-cell proliferation involving the CD28 pathway is associated with cyclosporine-resistant interleukin 2 gene expression. Mol Cell Biol 7, 4472-4481.

Kamphorst, A. O., Wieland, A., Nasti, T., Yang, S., Zhang, R., Barber, D. L., Konieczny, B. T., Daugherty, C. Z., Koenig, L., Yu, K., et al. (2017). Rescue of exhausted CD8 T cells by PD-1-targeted therapies is CD28-dependent. Science 355, 1423-1427.

Lavin, Y., Kobayashi, S., Leader, A., Amir, E. D., Elefant, N., Bigenwald, C., Remark, R., Sweeney, R., Becker, C. D., Levine, J. H., et al. (2017). Innate Immune Landscape in Early Lung Adenocarcinoma by Paired Single-Cell Analyses. Cell 169, 750-765 e717.

Linsley, P. S., Clark, E. A., and Ledbetter, J. A. (1990). T-cell antigen CD28 mediates adhesion with B cells by interacting with activation antigen B7/BB-1. Proc Natl Acad Sci USA 87, 5031-5035.

Moreau, P. and S. V. Rajkumar (2016). Multiple myeloma-translation of trial results into reality. Lancet, 388(10040): p. 111-113.

Murray M. E., Gavile C. M., Nair J. R., Koorella C., Carlson L. M., Buac D., Utley A., Chesi M., Bergsagel P. L., Boise L. H., Lee K. P. (2014). CD28-mediated pro-survival signaling induces chemotherapeutic resistance in multiple myeloma. Blood 123 (24), 3770-3779.

Romer, P. S., Berr, S., Avota, E., Na, S. Y., Battaglia, M., ten Berge, I., Einsele, H., and Hunig, T. (2011). Preculture of PBMCs at high cell density increases sensitivity of T-cell responses, revealing cytokine release by CD28 superagonist TGN1412. Blood 118, 6772-6782.

Tai, X., Van Laethem, F., Sharpe, A. H., and Singer, A. (2007). Induction of autoimmune disease in CTLA-4-/- mice depends on a specific CD28 motif that is required for in vivo costimulation. Proc Natl Acad Sci USA 104, 13756-13761.

Thompson, C. B., Lindsten, T., Ledbetter, J. A., Kunkel, S. L., Young, H. A., Emerson, S. G., Leiden, J. M., and June, C. H. (1989). CD28 activation pathway regulates the production of multiple T-cell-derived lymphokines/cytokines. Proc Natl Acad Sci USA 86, 1333-1337.

Tirosh, I., Izar, B., Prakadan, S. M., Wadsworth, M. H., 2nd, Treacy, D., Trombetta, J. J., Rotem, A., Rodman, C., Lian, C., Murphy, G., et al. (2016). Dissecting the multicellular ecosystem of metastatic melanoma by single-cell RNA-seq. Science 352, 189-196.

Zheng, C., Zheng, L., Yoo, J. K., Guo, H., Zhang, Y., Guo, X., Kang, B., Hu, R., Huang, J. Y., Zhang, Q., et al. (2017). Landscape of Infiltrating T Cells in Liver Cancer Revealed by Single-Cell Sequencing. Cell 169, 1342-1356 e1316

SEQUENCE LISTING (613 sequences)

SEQ ID NO: 1 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 2 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 3 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 4 - protein, 5 aa, Artificial Sequence
  FAP(28H1)  CDR-H1
SHAMS

SEQ ID NO: 5 - protein, 16 aa, Artificial Sequence
  FAP(28H1)  CDR-H2
AIWASGEQYYADSVKG

SEQ ID NO: 6 - protein, 8 aa, Artificial Sequence
  FAP(28H1)  CDR-H3
GWLGNFDY

SEQ ID NO: 7 - protein, 12 aa, Artificial Sequence
  FAP(28H1)  CDR-L1
RASQSVSRSYLA

SEQ ID NO: 8 - protein, 7 aa, Artificial Sequence
  FAP(28H1)  CDR-L2
GASTRAT

SEQ ID NO: 9 - protein, 9 aa, Artificial Sequence
  FAP(28H1)  CDR-L3
QQGQVIPPT

SEQ ID NO: 10 - protein, 116 aa, Artificial Sequence
  FAP(28H1) VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 11 - protein, 108 aa, Artificial Sequence
  FAP(28H1) VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 12 - protein, 5 aa, Artificial Sequence
  FAP(4B9)  CDR-H1
SYAMS

SEQ ID NO: 13 - protein, 17 aa, Artificial Sequence
  FAP(4B9)  CDR-H2
AIIGSGASTYYADSVKG

SEQ ID NO: 14 - protein, 8 aa, Artificial Sequence
  FAP(4B9)  CDR-H3
GWFGGFNY

SEQ ID NO: 15 - protein, 12 aa, Artificial Sequence
  FAP(4B9)  CDR-L1
RASQSVSRSYLA

SEQ ID NO: 16 - protein, 7 aa, Artificial Sequence
  FAP(4B9)  CDR-L2
VGSRRAT

SEQ ID NO: 17 - protein, 9 aa, Artificial Sequence
  FAP(4B9)  CDR-L3
QQGIMLPPT

SEQ ID NO: 18 - protein, 117 aa, Artificial Sequence
  FAP(4B9)  VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 19 - protein, 108 aa, Artificial Sequence
  FAP(4B9)  VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 20 - protein, 5 aa, Artificial Sequence
  CD28(SA) CDR-H1
SYYIH

SEQ ID NO: 21 - protein, 17 aa, Artificial Sequence
  CD28(SA) CDR-H2
CIYPGNVNTNYNEKFKD

SEQ ID NO: 22 - protein, 11 aa, Artificial Sequence
  CD28(SA) CDR-H3
SHYGLDWNFDV

SEQ ID NO: 23 - protein, 11 aa, Artificial Sequence
  CD28(SA) CDR-L1
HASQNIYVWLN

SEQ ID NO: 24 - protein, 7 aa, Artificial Sequence
  CD28(SA) CDR-L2
KASNLHT

SEQ ID NO: 25 - protein, 9 aa, Artificial Sequence
  CD28(SA) CDR-L3
QQGQTYPYT

SEQ ID NO: 26 - protein, 120 aa, Artificial Sequence
  CD28(SA) VH
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSS

SEQ ID NO: 27 - protein, 107 aa, Artificial Sequence
  CD28(SA) VL
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIK

SEQ ID NO: 28 - protein, 5 aa, Artificial Sequence
  CD28(mAb 9.3) CDR-H1
DYGVH

SEQ ID NO: 29 - protein, 16 aa, Artificial Sequence
  CD28(mAb 9.3) CDR-H2
VIWAGGGTNYNSALMS

SEQ ID NO: 30 - protein, 12 aa, Artificial Sequence
  CD28(mAb 9.3) CDR-H3
DKGYSYYYSMDY

SEQ ID NO: 31 - protein, 15 aa, Artificial Sequence
  CD28(mAb 9.3) CDR-L1
RASESVEYYVTSLMQ

SEQ ID NO: 32 - protein, 7 aa, Artificial Sequence
  CD28(mAb 9.3) CDR-L2
AASNVES

SEQ ID NO: 33 - protein, 9 aa, Artificial Sequence
  CD28(mAb 9.3) CDR-L3
QQSRKVPYT

SEQ ID NO: 34 - protein, 120 aa, Artificial Sequence
  CD28(mAb 9.3) VH
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSS

SEQ ID NO: 35 - protein, 111 aa, Artificial Sequence
  CD28(mAb 9.3) VL
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIK

SEQ ID NO: 36 - protein, 5 aa, Artificial Sequence
  CD28 CDR-H1 consensus
SYYIH

SEQ ID NO: 37 - protein, 17 aa, Artificial Sequence
  CD28 CDR-H2 consensus
  VARIANT (5)..(5): Gly or Arg
  VARIANT (6)..(6): Asn or Asp
  VARIANT (7)..(7): Val or Gly
  VARIANT (8)..(8): Asn, Gln or Ala
SIYPXXXXTNYNEKFKD

SEQ ID NO: 38 - protein, 11 aa, Artificial Sequence
  CD28 CDR-H3 consensus
  VARIANT (5)..(5): Leu or Ala
  VARIANT (7)..(7): Trp, His, Tyr or Phe
SHYGXDXNFDV

SEQ ID NO: 39 - protein, 11 aa, Artificial Sequence
  CD28 CDR-L1 consensus
  VARIANT (1)..(1): His or Arg
  VARIANT (5)..(5): Asn or Gly
  VARIANT (7)..(7): Tyr or Ser
  VARIANT (8)..(8): Val or Asn
  VARIANT (9)..(9): Trp, His, Phe or Tyr
XASQXIXXXLN

SEQ ID NO: 40 - protein, 7 aa, Artificial Sequence
  CD28 CDR-L2 consensus
  VARIANT (1)..(1): Lys or Tyr
  VARIANT (2)..(2): Ala or Gly
  VARIANT (4)..(4): Asn or Ser
  VARIANT (6)..(6): His or Tyr
  VARIANT (7)..(7): Thr or Ser
XXSXLXX

SEQ ID NO: 41 - protein, 9 aa, Artificial Sequence
  CD28 CDR-L3 consensus
  VARIANT (3)..(3): Gly or Ala
QQXQTYPYT

SEQ ID NO: 42 - protein, 120 aa, Artificial Sequence
  CD28 VH variant a
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSS

SEQ ID NO: 43 - protein, 120 aa, Artificial Sequence
  CD28 VH variant b
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDHNFDVWGQGTTVTVSS

SEQ ID NO: 44 - protein, 120 aa, Artificial Sequence
  CD28 VH variant c
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGADHNFDVWGQGTTVTVSS

SEQ ID NO: 45 - protein, 120 aa, Artificial Sequence
  CD28 VH variant d
QVQLVQSGAEVKKPGASVKVSCKASGYTFTSYYIHWVRQAPGQGLEWIGSIYPRDGQTNYNEKFKDRATLTVDTSISTAYMELSRLRSDDTAVYFCTRSHYGLDYNFDVWGQGTTVTVSS

SEQ ID NO: 46 - protein, 120 aa, Artificial Sequence
  CD28 VH variant e
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDWNFDVWGQGTTVTVSS

SEQ ID NO: 47 - protein, 120 aa, Artificial Sequence
  CD28 VH variant f
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDFNFDVWGQGTTVTVSS

SEQ ID NO: 48 - protein, 120 aa, Artificial Sequence
  CD28 VH variant g
QVQLVQSGAEVKKPGASVKVSCKASGYTFTSYYIHWVRQAPGQGLEWIGSIYPRNVQTNYNEKFKDRATLTVDTSISTAYMELSRLRSDDTAVYFCTRSHYGLDHNFDVWGQGTTVTVSS

SEQ ID NO: 49 - protein, 120 aa, Artificial Sequence
  CD28 VH variant h
QVQLVQSGAEVKKPGASVKVSCKASGYTFTSYYIHWVRQAPGQGLEWIGSIYPRDVQTNYNEKFKDRATLTVDTSISTAYMELSRLRSDDTAVYFCTRSHYGLDHNFDVWGQGTTVTVSS

SEQ ID NO: 50 - protein, 120 aa, Artificial Sequence
  CD28 VH variant i
EVQLVESGGGLVQPGGSLRLSCAASGFTFTSYYIHWVRQAPGKGLEWVASIYPGNVNTRYADSVKGRFTISADTSKNTAYLQMNSLRAEDTAVYYCTRSHYGLDWNFDVWGQGTTVTVSS

SEQ ID NO: 51 - protein, 120 aa, Artificial Sequence
  CD28 VH variant j
EVQLVESGGGLVQPGGSLRLSCAASGFTFTSYYIHWVRQAPGKGLEWVASIYPGNVATRYADSVKGRFTISADTSKNTAYLQMNSLRAEDTAVYYCTRSHYGLDWNFDVWGQGTTVTVSS

SEQ ID NO: 52 - protein, 107 aa, Artificial Sequence
  CD28 VL variant k
DIQMTQSPSSLSASVGDRVTITCHASQNIYVHLNWYQQKPGKAPKLLIYKASNLHTGVPSRFSGSGSGTDFTLTISSLQPEDFATYYCQQAQTYPYTFGGGTKVEIK

SEQ ID NO: 53 - protein, 107 aa, Artificial Sequence
  CD28 VL variant l
DIQMTQSPSSLSASVGDRVTITCHASQNIYVFLNWYQQKPGKAPKLLIYKASNLHTGVPSRFSGSGSGTDFTLTISSLQPEDFATYYCQQGQTYPYTFGGGTKVEIK

SEQ ID NO: 54 - protein, 107 aa, Artificial Sequence
  CD28 VL variant m
DIQMTQSPSSLSASVGDRVTITCHASQNIYVYLNWYQQKPGKAPKLLIYKASNLHTGVPSRFSGSGSGTDFTLTISSLQPEDFATYYCQQGQTYPYTFGGGTKVEIK

SEQ ID NO: 55 - protein, 107 aa, Artificial Sequence
  CD28 VL variant n
DIQMTQSPSSLSASVGDRVTITCHASQGISNYLNWYQQKPGKAPKLLIYKASNLHTGVPSRFSGSGSGTDFTLTISSLQPEDFATYYCQQGQTYPYTFGGGTKVEIK

SEQ ID NO: 56 - protein, 107 aa, Artificial Sequence
  CD28 VL variant o
DIQMTQSPSSLSASVGDRVTITCHASQNIYVWLNWYQQKPGKAPKLLIYYTSSLHSGVPSRFSGSGSGTDFTLTISSLQPEDFATYYCQQGQTYPYTFGGGTKVEIK

SEQ ID NO: 57 - protein, 107 aa, Artificial Sequence
  CD28 VL variant p
DIQMTQSPSSLSASVGDRVTITCHASQGISNYLNWYQQKPGKAPKLLIYYTSSLHSGVPSRFSGSGSGTDFTLTISSLQPEDFATYYCQQGQTYPYTFGGGTKVEIK

SEQ ID NO: 58 - protein, 107 aa, Artificial Sequence
  CD28 VL variant q
DIQMTQSPSSLSASVGDRVTITCHASQGISNHLNWYQQKPGKAPKLLIYKASNLHTGVPSRFSGSGSGTDFTLTISSLQPEDFATYYCQQGQTYPYTFGGGTKVEIK

SEQ ID NO: 59 - protein, 107 aa, Artificial Sequence
  CD28 VL variant r
DIQMTQSPSSLSASVGDRVTITCHASQGIYVYLNWYQQKPGKAPKLLIYKASNLHTGVPSRFSGSGSGTDFTLTISSLQPEDFATYYCQQGQTYPYTFGGGTKVEIK

SEQ ID NO: 60 - protein, 107 aa, Artificial Sequence
  CD28 VL variant s
DIQMTQSPSSLSASVGDRVTITCHASQGISVYLNWYQQKPGKAPKLLIYKASNLHTGVPSRFSGSGSGTDFTLTISSLQPEDFATYYCQQGQTYPYTFGGGTKVEIK

SEQ ID NO: 61 - protein, 107 aa, Artificial Sequence
  CD28 VL variant t
DIQMTQSPSSLSASVGDRVTITCRASQNIYVWLNWYQQKPGKAPKLLIYKASNLYSGVPSRFSGSRSGTDFTLTISSLQPEDFATYYCQQGQTYPYTFGQGTKLEIK

SEQ ID NO: 62 - protein, 214 aa, Artificial Sequence
  CD28(SA) light chain
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 447 aa, Artificial Sequence
  CD28(SA) hu IgG4 heavy chain
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - protein, 450 aa, Artificial Sequence
  CD28(SA) hu IgG1 PGLALA heavy chain
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 214 aa, Artificial Sequence
  CD28(SA)  hu IgG light chain "RK"
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 448 aa, Artificial Sequence
  CD28(SA) hu IgG1 PGLALA Fc knob
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 67 - protein, 438 aa, Artificial Sequence
  FAP(4B9) VL-CH hu IgG1 PGLALA Fc hole
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 68 - protein, 224 aa, Artificial Sequence
  FAP(4B9) VH-Ckappa
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 820 aa, Artificial Sequence
  CD28(SA) VHCH-VHCH Fc knob FAP(4B9) VH PGLALA
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 70 - protein, 811 aa, Artificial Sequence
  CD28(SA) VHCH-VHCH Fc hole FAP(4B9) VL PGLALA
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 71 - protein, 586 aa, Artificial Sequence
  CD28(SA) VHCH- Fc knob FAP(4B9) VH
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 72 - protein, 577 aa, Artificial Sequence
  CD28(SA) VHCH- Fc hole FAP(4B9) VL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 73 - protein, 693 aa, Artificial Sequence
  CD28(SA) VHCH "EE"- Fc PGLALA FAP(4B9) VHCL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 214 aa, Artificial Sequence
  FAP(4B9) VLCH1
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 75 - protein, 668 aa, Artificial Sequence
  CD28(SA) VLCH1- FAP(4B9) VHCH1 "EE"- Fc knob PGLALA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 76 - protein, 445 aa, Artificial Sequence
  FAP(4B9) VHCH1 "EE"- Fc hole PGLALA
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 77 - protein, 227 aa, Artificial Sequence
  CD28(SA) VHCL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 215 aa, Artificial Sequence
  FAP(4B9) VLCL "RK"
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 225 aa, Artificial Sequence
  Fc hole PGLALA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 80 - protein, 363 aa, Artificial Sequence
  Fc knob -FAP(4B9) VH
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 81 - protein, 697 aa, Artificial Sequence
  CD28(SA) VHCH1 "EE"- Fc PGLALA CEA(Medi-565) VHCL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 82 - protein, 221 aa, Artificial Sequence
  CEA-VLCH1
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 83 - protein, 590 aa, Artificial Sequence
  CD28(SA) VHCH1- Fc knob CEA VH
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 84 - protein, 585 aa, Artificial Sequence
  CD28(SA) VHCH1- Fc hole CEA VL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 85 - protein, 448 aa, Artificial Sequence
  CD28(SA) VHCH1 "EE"- Fc hole PGLALA HYRF
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSP

SEQ ID NO: 86 - protein, 225 aa, Artificial Sequence
  Fc knob PGLALA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 87 - protein, 446 aa, Artificial Sequence
  CEA VL-CH hu IgG1 PGLALA Fc hole
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 88 - protein, 228 aa, Artificial Sequence
  CEA VH-CL
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 218 aa, Artificial Sequence
  CD28(mAb 9.3) light chain
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 448 aa, Artificial Sequence
  CD28(mAb 9.3) hu IgG1 PGLALA heavy chain
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 91 - protein, 218 aa, Artificial Sequence
  CD28(mAb 9.3) hu IgG light chain "RK"
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 448 aa, Artificial Sequence
  CD28(mAb 9.3) hu IgG1 PGLALA Fc knob "EE"
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 93 - protein, 820 aa, Artificial Sequence
  CD28(mAb 9.3) VHCH-VHCH Fc knob FAP(4B9) VH PGLALA
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 94 - protein, 811 aa, Artificial Sequence
  CD28(mAb 9.3) VHCH-VHCH Fc hole FAP(4B9) VL PGLALA
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 95 - protein, 586 aa, Artificial Sequence
  CD28(mAb 9.3) VHCH- Fc knob FAP(4B9) VH
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 96 - protein, 577 aa, Artificial Sequence
  CD28(mAb 9.3) VHCH- Fc hole FAP(4B9) VL
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 97 - protein, 693 aa, Artificial Sequence
  CD28(mAb 9.3) VHCH "EE"- Fc PGLALA FAP(4B9) VHCL
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 218 aa, Artificial Sequence; identical to SEQ ID NO: 91
  CD28(mAb 9.3) VLCL "RK"

SEQ ID NO: 99 - protein, 213 aa, Artificial Sequence
  FAP(4B9) VL-CH1
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 100 - protein, 672 aa, Artificial Sequence
  CD28(mAb 9.3) VLCH1- FAP(4B9) VHCH1 "EE"- Fc knob PGLALA
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 101 - protein, 227 aa, Artificial Sequence
  CD28(mAb 9.3) VHCL
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 697 aa, Artificial Sequence
  CD28(mAb 9.3) VHCH1 "EE"- Fc PGLALA CEA VHCL
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 590 aa, Artificial Sequence
  CD28(mAb 9.3) VHCH1- Fc knob CEA VH
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 104 - protein, 585 aa, Artificial Sequence
  CD28(mAb 9.3) VHCH1- Fc hole CEA VL
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 105 - protein, 448 aa, Artificial Sequence
  CD28(mAb 9.3) VHCH1 "EE"- Fc hole PGLALA HYRF
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 106 - protein, 218 aa, Artificial Sequence; identical to SEQ ID NO: 91
  CD28(mAb 9.3) VLCL "RK"

SEQ ID NO: 107 - protein, 834 aa, Artificial Sequence
  CD28(SA) VHCH1 "EE" Fc hole PGLALA FAP(4B9) VH - CEA(Medi-565) VHCL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 577 aa, Artificial Sequence
  CD28(SA) VHCH1 "EE" Fc knob PGLALA FAP(4B9) VL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 109 - protein, 221 aa, Artificial Sequence; identical to SEQ ID NO: 82
  CEA VLCH1

SEQ ID NO: 110 - protein, 727 aa, Artificial Sequence
  CD28(SA) VHCH1 Fc hole PGLALA FAP(4B9) VH - CEA VH
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 111 - protein, 713 aa, Artificial Sequence
  CD28(SA) VHCH1 Fc knob PGLALA FAP(4B9) VL - CEA VL
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 112 - protein, 448 aa, Artificial Sequence; identical to SEQ ID NO: 66
  VH (CD28 parental) CH1- Fc knob PGLALA

SEQ ID NO: 113 - protein, 448 aa, Artificial Sequence
  VH (CD28 variant g) CH1- Fc knob PGLALA
QVQLVQSGAEVKKPGASVKVSCKASGYTFTSYYIHWVRQAPGQGLEWIGSIYPRNVQTNYNEKFKDRATLTVDTSISTAYMELSRLRSDDTAVYFCTRSHYGLDHNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 114 - protein, 448 aa, Artificial Sequence
  VH (CD28 variant f) CH1- Fc knob PGLALA
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDFNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 115 - protein, 448 aa, Artificial Sequence
  VH (CD28 variant j) CH1- Fc knob PGLALA
EVQLVESGGGLVQPGGSLRLSCAASGFTFTSYYIHWVRQAPGKGLEWVASIYPGNVATRYADSVKGRFTISADTSKNTAYLQMNSLRAEDTAVYYCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 116 - protein, 448 aa, Artificial Sequence
  VH (CD28 variant e) CH1- Fc knob PGLALA
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 117 - protein, 448 aa, Artificial Sequence
  VH (CD28 variant b) CH1- Fc knob PGLALA
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDHNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 118 - protein, 448 aa, Artificial Sequence
  VH (CD28 variant a) CH1- Fc knob PGLALA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 119 - protein, 448 aa, Artificial Sequence
  VH (CD28 variant i) CH1- Fc knob PGLALA
EVQLVESGGGLVQPGGSLRLSCAASGFTFTSYYIHWVRQAPGKGLEWVASIYPGNVNTRYADSVKGRFTISADTSKNTAYLQMNSLRAEDTAVYYCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 120 - protein, 214 aa, Artificial Sequence
  VL (CD28 variant k)-CL
DIQMTQSPSSLSASVGDRVTITCHASQNIYVHLNWYQQKPGKAPKLLIYKASNLHTGVPSRFSGSGSGTDFTLTISSLQPEDFATYYCQQAQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 214 aa, Artificial Sequence
  VL (CD28 variant l)-CL
DIQMTQSPSSLSASVGDRVTITCHASQNIYVFLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 214 aa, Artificial Sequence
  VL (CD28 variant m)-CL
DIQMTQSPSSLSASVGDRVTITCHASQNIYVYLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 123 - protein, 214 aa, Artificial Sequence
  VL (CD28 variant r)-CL
DIQMTQSPSSLSASVGDRVTITCHASQGIYVYLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 214 aa, Artificial Sequence
  VL (CD28 variant s)-CL
DIQMTQSPSSLSASVGDRVTITCHASQGISVYLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 214 aa, Artificial Sequence
  VL (CD28 variant t)-CL
DIQMTQSPSSLSASVGDRVTITCRASQNIYVWLNWYQQKPGKAPKLLIYKASNLYSGVPSRFSGSRSGTDFTLTISSLQPEDFATYYCQQGQTYPYTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 225 aa, Artificial Sequence
  Fc hole PGLALA, HYRF
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSP

SEQ ID NO: 127 - protein, 5 aa, Artificial Sequence
  CEA CDR-H1
SYWMH

SEQ ID NO: 128 - protein, 19 aa, Artificial Sequence
  CEA CDR-H2
FIRNKANGGTTEYAASVKG

SEQ ID NO: 129 - protein, 10 aa, Artificial Sequence
  CEA CDR-H3
DRGLRFYFDY

SEQ ID NO: 130 - protein, 14 aa, Artificial Sequence
  CEA CDR-L1
TLRRGINVGAYSIY

SEQ ID NO: 131 - protein, 13 aa, Artificial Sequence
  CEA CDR-L2
YKSDSDKQQGSGV

SEQ ID NO: 132 - protein, 10 aa, Artificial Sequence
  CEA CDR-L3
MIWHSGASAV

SEQ ID NO: 133 - protein, 121 aa, Artificial Sequence
  CEA VH
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 134 - protein, 116 aa, Artificial Sequence
  CEA VL
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 135 - protein, 748 aa, Artificial Sequence
  His-tagged human FAP ECD
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 136 - protein, 761 aa, murine
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 137 - protein, 749 aa, Artificial Sequence
  Murine FAP ectodomain+poly-lys-tag+his6-tag
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDGKKKKKKGHHHHHH

SEQ ID NO: 138 - protein, 748 aa, Artificial Sequence
  Cynomolgus FAP ectodomain+poly-lys-tag+his6-tag
RPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 139 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 140 - protein, 255 aa, Mus musculus
MAHLMTVQLLLLVMWMAECAQSRATRARTELLNVCMDAKHHKEKPGPEDNLHDQCSPWKTNSCCSTNTSQEAHKDISYLYRFNWNHCGTMTSECKRHFIQDTCLYECSPNLGPWIQQVDQSWRKERILDVPLCKEDCQQWWEDCQSSFTCKSNWHKGWNWSSGHNECPVGASCHPFTFYFPTSAALCEEIWSHSYKLSNYSRGSGRCIQMWFDPAQGNPNEEVARFYAEAMSGAGFHGTWPLLCSLSLVLLWVIS

SEQ ID NO: 141 - protein, 257 aa, Cynomolgus
MAQRMTTQLLLLLVWVAVVGEAQTRTARARTELLNVCMNAKHHKEKPGPEDKLHEQCRPWKKNACCSTNTSQEAHKDVSYLYRFNWNHCGEMAPACKRHFIQDTCLYECSPNLGPWIQQVDQSWRKERVLNVPLCKEDCERWWEDCRTSYTCKSNWHKGWNWTSGFNKCPVGAACQPFHFYFPTPTVLCNEIWTYSYKVSNYSRGSGRCIQMWFDPAQGNPNEEVARFYAAAMSGAGPWAAWPLLLSLALTLLWLLS

SEQ ID NO: 142 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 143 - protein, 1210 aa, Homo sapiens [sequence omitted]

SEQ ID NO: 144 - protein, 1255 aa, Homo sapiens [sequence omitted]

SEQ ID NO: 145 - protein, 645 aa, Homo sapiens
MPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 146 - protein, 5 aa, Artificial Sequence
  Peptide linker G4S
GGGGS

SEQ ID NO: 147 - protein, 10 aa, Artificial Sequence
  Peptide linker (G4S)2
GGGGSGGGGS

SEQ ID NO: 148 - protein, 10 aa, Artificial Sequence
  Peptide linker (SG4)2
SGGGGSGGGG

SEQ ID NO: 149 - protein, 14 aa, Artificial Sequence
  Peptide linker G4(SG4)2
GGGGSGGGGSGGGG

SEQ ID NO: 150 - protein, 10 aa, Artificial Sequence
  Peptide linker
GSPGSSSSGS

SEQ ID NO: 151 - protein, 15 aa, Artificial Sequence
  Peptide linker (G4S)3
GGGGSGGGGSGGGGS

SEQ ID NO: 152 - protein, 20 aa, Artificial Sequence
  Peptide linker (G4S)4
GGGGSGGGGSGGGGSGGGGS

SEQ ID NO: 153 - protein, 8 aa, Artificial Sequence
  Peptide linker
GSGSGSGS

SEQ ID NO: 154 - protein, 8 aa, Artificial Sequence
  Peptide linker
GSGSGNGS

SEQ ID NO: 155 - protein, 8 aa, Artificial Sequence
  Peptide linker
GGSGSGSG

SEQ ID NO: 156 - protein, 6 aa, Artificial Sequence
  Peptide linker
GGSGSG

SEQ ID NO: 157 - protein, 4 aa, Artificial Sequence
  Peptide linker
GGSG

SEQ ID NO: 158 - protein, 8 aa, Artificial Sequence
  Peptide linker
GGSGNGSG

SEQ ID NO: 159 - protein, 8 aa, Artificial Sequence
  Peptide linker
GGNGSGSG

SEQ ID NO: 160 - protein, 6 aa, Artificial Sequence
  Peptide linker
GGNGSG

SEQ ID NO: 161 - protein, 215 aa, Artificial Sequence
  Light chain CEA 2F1" (CEA TCB)
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 214 aa, Artificial Sequence
  Light Chain humanized CD3 CH2527 (Crossfab, VL-CH1) (CEA TCB)
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 163 - protein, 692 aa, Artificial Sequence
  CEA CH1A1A 98/99 - humanized CD3 CH2527 (Crossfab VH-Ck)-Fc(knob) P329GLALA (CEA TCB)
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 164 - protein, 449 aa, Artificial Sequence
  CEA CH1A1A 98/99 (VH-CH1)-Fc(hole) P329GLALA (CEA TCB)
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 165 - protein, 232 aa, Artificial Sequence
  CD3 VH-CL (CEACAM5 TCB)
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 449 aa, Artificial Sequence
  humanized CEA VH-CH1(EE)-Fc (hole, P329G LALA) (CEACAM5 TCB)
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 167 - protein, 674 aa, Artificial Sequence
  humanized CEA VH-CH1(EE)-CD3 VL-CH1-Fc (knob, P329G LALA) (CEACAM5 TCB)
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 168 - protein, 218 aa, Artificial Sequence
  humanized CEA VL-CL(RK) (CEACAM5 TCB)
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 420 aa, Artificial Sequence
  CEACAM5-based antigen Hu N(A2-B2)A-avi-His
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSALSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDGSGLNDIFEAQKIEWHEARAHHHHHH

SEQ ID NO: 170 - protein, 5 aa, Artificial Sequence
  CEA (A5B7)- CDR-H1
DYYMN

SEQ ID NO: 171 - protein, 19 aa, Artificial Sequence
  CEA (A5B7)- CDR-H2
FIGNKANGYTTEYSASVKG

SEQ ID NO: 172 - protein, 10 aa, Artificial Sequence
  CEA (A5B7)- CDR-H3
DRGLRFYFDY

SEQ ID NO: 173 - protein, 10 aa, Artificial Sequence
  CEA (A5B7)- CDR-L1
RASSSVTYIH

SEQ ID NO: 174 - protein, 7 aa, Artificial Sequence
  CEA (A5B7)- CDR-L2
ATSNLAS

SEQ ID NO: 175 - protein, 9 aa, Artificial Sequence
  CEA (A5B7)- CDR-L3
QHWSSKPPT

SEQ ID NO: 176 - protein, 215 aa, Artificial Sequence
  IgG1 Fc knob PGLALA
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 177 - protein, 215 aa, Artificial Sequence
  IgG1 Fc hole PGLALA
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 178 - protein, 121 aa, Artificial Sequence
  CEA (A5B7) VH (parental)
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 179 - protein, 106 aa, Artificial Sequence
  CEA (A5B7) VL (parental)
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 180 - protein, 10 aa, Artificial Sequence
  CEA (A5H1EL1D)- CDR-H1
GFTFTDYYMN

SEQ ID NO: 181 - protein, 19 aa, Artificial Sequence
  CEA (A5H1EL1D)- CDR-H2
FIGNKANAYTTEYSASVKG

SEQ ID NO: 182 - protein, 10 aa, Artificial Sequence
  CEA (A5H1EL1D)- CDR-H3
DRGLRFYFDY

SEQ ID NO: 183 - protein, 10 aa, Artificial Sequence
  CEA (A5H1EL1D)- CDR-L1
RASSSVTYIH

SEQ ID NO: 184 - protein, 7 aa, Artificial Sequence
  CEA (A5H1EL1D)- CDR-L2
ATSNLAS

SEQ ID NO: 185 - protein, 9 aa, Artificial Sequence
  CEA (A5H1EL1D)- CDR-L3
QHWSSKPPT

SEQ ID NO: 186 - protein, 121 aa, Artificial Sequence
  CEA (A5H1EL1D) VH (3-23A5-1E)
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSS

SEQ ID NO: 187 - protein, 106 aa, Artificial Sequence
  CEA (A5H1EL1D) VL (A5-L1D)
EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIK

SEQ ID NO: 188 - protein, 10 aa, Artificial Sequence
  CEA (A5H1EL1D aff. mat.) CDR-H1 consensus
  VARIANT (3)..(3): X is Thr or Tyr
  VARIANT (5)..(5): X is Thr or Ser
  VARIANT (8)..(8): X is Tyr or Ala or Glu
GFXFXDYXMN

SEQ ID NO: 189 - protein, 19 aa, Artificial Sequence
  CEA (A5H1EL1D aff. mat.) CDR-H2 consensus
  VARIANT (1)..(1): X is Phe or Val
  VARIANT (3)..(3): X is Gly or Ser
XIXNKANAYTTEYSASVKG

SEQ ID NO: 190 - protein, 10 aa, Artificial Sequence
  CEA (A5H1EL1D aff. mat.) CDR-H3 consensus
  VARIANT (4)..(4): X is Leu or Ile
  VARIANT (7)..(7): X is Tyr or Gly or Gln or Ser
DRGXRFXFDY

SEQ ID NO: 191 - protein, 10 aa, Artificial Sequence
  CEA (A5H1EL1D aff. mat.) CDR-L1 consensus
  VARIANT (1)..(1): X is Arg or His
XASSSVTYIH

SEQ ID NO: 192 - protein, 7 aa, Artificial Sequence
  CEA (A5H1EL1D aff. mat.) CDR-L2 consensus
ATSNLAS

SEQ ID NO: 193 - protein, 9 aa, Artificial Sequence
  CEA (A5H1EL1D aff. mat.) CDR-L3 consensus
  VARIANT (6)..(6): X is Lys or Val or Gln or Ile
  VARIANT (7)..(7): X is Pro or Ser
QHWSSXXPT

SEQ ID NO: 194 - protein, 121 aa, Artificial Sequence
  CEA (P006.038) VH
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFGFDYWGQGTTVTVSS

SEQ ID NO: 195 - protein, 106 aa, Artificial Sequence
  CEA (P006.038) VL
EIVLTQSPATLSLSPGERATLSCRASSSVTYIHWYQQKPGQAPRSWIYATSNLASGIPARFSGSGSGTDFTLTISSLEPEDFAVYYCQHWSSVPPTFGQGTKLEIK

SEQ ID NO: 196 - protein, 121 aa, Artificial Sequence
  CEA (P005.097) VH
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFSFDYWGQGTTVTVSS

SEQ ID NO: 197 - protein, 106 aa, Artificial Sequence
  CEA (P005.097) VL
EIVLTQSPATLSLSPGERATLSCRASSSVTYIHWYQQKPGQAPRSWIYATSNLASGIPARFSGSGSGTDFTLTISSLEPEDFAVYYCQHWSSQPPTFGQGTKLEIK

SEQ ID NO: 198 - protein, 121 aa, Artificial Sequence
  CEA (P005.103) VH
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFYFDYWGQGTTVTVSS

SEQ ID NO: 199 - protein, 106 aa, Artificial Sequence
  CEA (P005.103) VL
EIVLTQSPATLSLSPGERATLSCRASSSVTYIHWYQQKPGQAPRSWIYATSNLASGIPARFSGSGSGTDFTLTISSLEPEDFAVYYCQHWSSISPTFGQGTKLEIK

SEQ ID NO: 200 - protein, 121 aa, Artificial Sequence
  CEA (P002.139) VH
EVQLLESGGGLVQPGGSLRLSCAASGFYFTDYAMNWVRQAPGKGLEWLGVISNKANAYTTEYSASVKGRFTISRDKSKNTLYLQMNSLRAEDTATYYCTRDRGLRFYFDYWGQGTTVTVSS

SEQ ID NO: 201 - protein, 106 aa, Artificial Sequence
  CEA (P002.139) VL
EIVLTQSPATLSLSPGERATLSCHASSSVTYIHWYQQKPGQAPRSWIYATSNLASGIPARFSGSGSGTDFTLTISSLEPEDFAVYYCQHWSSKPPTFGQGTKLEIK

SEQ ID NO: 202 - protein, 121 aa, Artificial Sequence
  CEA (P001.177) VH
EVQLLESGGGLVQPGGSLRLSCAASGFYFTDYYMNWVRQAPGKGLEWLGFISNKANAYTTEYSASVKGRFTISRDKSKNTLYLQMNSLRAEDTATYYCTRDRGLRFYFDYWGQGTTVTVSS

SEQ ID NO: 203 - protein, 106 aa, Artificial Sequence; identical to SEQ ID NO: 187
  CEA (P001.177) VL

SEQ ID NO: 204 - protein, 121 aa, Artificial Sequence
  CEA (P005.102) VH
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFQFDYWGQGTTVTVSS

SEQ ID NO: 205 - protein, 106 aa, Artificial Sequence
  CEA (P005.102) VL
EIVLTQSPATLSLSPGERATLSCRASSSVTYIHWYQQKPGQAPRSWIYATSNLASGIPARFSGSGSGTDFTLTISSLEPEDFAVYYCQHWSSKSPTFGQGTKLEIK

SEQ ID NO: 206 - protein, 121 aa, Artificial Sequence
  CEA (P005.102 combo1) VH
EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFQFDYWGQGTTVTVSS

SEQ ID NO: 207 - protein, 106 aa, Artificial Sequence; identical to SEQ ID NO: 205
  CEA (P005.102 combo1) VL

SEQ ID NO: 208 - protein, 121 aa, Artificial Sequence
  CEA (P005.102 combo2) VH
EVQLLESGGGLVQPGGSLRLSCAASGFYFSDYYMNWVRQAPGKGLEWLGVISNKANAYTTEYSASVKGRFTISRDKSKNTLYLQMNSLRAEDTATYYCTRDRGIRFQFDYWGQGTTVTVSS

SEQ ID NO: 209 - protein, 106 aa, Artificial Sequence; identical to SEQ ID NO: 205
  CEA (P005.102 combo2) VL

SEQ ID NO: 210 - protein, 121 aa, Artificial Sequence
  CEA (P005.103 combo1) VH
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFSFDYWGQGTTVTVSS

SEQ ID NO: 211 - protein, 106 aa, Artificial Sequence; identical to SEQ ID NO: 199
  CEA (P005.103 combo1) VL

SEQ ID NO: 212 - protein, 121 aa, Artificial Sequence
  CEA (P005.103 combo2) VH
EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFSFDYWGQGTTVTVSS

SEQ ID NO: 213 - protein, 106 aa, Artificial Sequence; identical to SEQ ID NO: 199
  CEA (P005.103 combo2) VL

SEQ ID NO: 214 - protein, 121 aa, Artificial Sequence
  CEA (P006.038 combo1) VH
EVQLLESGGGLVQPGGSLRLSCAASGFYFTDYAMNWVRQAPGKGLEWLGVISNKANAYTTEYSASVKGRFTISRDKSKNTLYLQMNSLRAEDTATYYCTRDRGIRFGFDYWGQGTTVTVSS

SEQ ID NO: 215 - protein, 106 aa, Artificial Sequence; identical to SEQ ID NO: 195
  CEA (P006.038 combo1) VL

SEQ ID NO: 216 - protein, 121 aa, Artificial Sequence
  CEA (P006.038 combo2) VH
EVQLLESGGGLVQPGGSLRLSCAASGFTFSDYEMNWVRQAPGKGLEWLGFISNKANAYTTEYSASVKGRFTISRDKSKNTLYLQMNSLRAEDTATYYCTRDRGIRFGFDYWGQGTTVTVSS

SEQ ID NO: 217 - protein, 106 aa, Artificial Sequence; identical to SEQ ID NO: 195
  CEA (P006.038 combo2) VL

SEQ ID NO: 218 - protein, 98 aa, Artificial Sequence
  IGHV3-23-02
EVQLLESGGGLVQPGGSLRLSCAASGFTFSSYAMSWVRQAPGKGLEWVSAISGSGGSTYYGDSVKGRFTISRDNSKNTLYLQMNSLRAEDTAVYYCAK

SEQ ID NO: 219 - protein, 100 aa, Artificial Sequence
  IGHV3-15*01
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT

SEQ ID NO: 220 - protein, 121 aa, Artificial Sequence
  3-23A5-1
EVQLLESGGGLVQPGGSLRLSCAASGFTFTDYYMNWVRQAPGKGLEWVGFIGNKANGYTTEYSASVKGRFTISRDNSKNTLYLQMNSLRAEDTAVYYCARDRGLRFYFDYWGQGTTVTVSS

SEQ ID NO: 221 - protein, 121 aa, Artificial Sequence
  3-23A5-2
EVQLLESGGGLVQPGGSLRLSCAASGFTFTDYYMNWVRQAPGKGLEWVGFIGNKANGYTTYYGDSVKGRFTISRDNSKNTLYLQMNSLRAEDTAVYYCARDRGLRFYFDYWGQGTTVTVSS

SEQ ID NO: 222 - protein, 119 aa, Artificial Sequence
  3-23A5-3
EVQLLESGGGLVQPGGSLRLSCAASGFTFTDYYMNWVRQAPGKGLEWVGFIGNKGYTTEYSASVKGRFTISRDNSKNTLYLQMNSLRAEDTAVYYCARDRGLRFYFDYWGQGTTVTVSS

SEQ ID NO: 223 - protein, 121 aa, Artificial Sequence
  3-23A5-4
EVQLLESGGGLVQPGGSLRLSCAASGFTFTDYYMSWVRQAPGKGLEWVGFIGNKANGYTTEYSASVKGRFTISRDNSKNTLYLQMNSLRAEDTAVYYCARDRGLRFYFDYWGQGTTVTVSS

SEQ ID NO: 224 - protein, 121 aa, Artificial Sequence
  3-23A5-1A (all_backmutations)
EVQLLESGGGLVQPGGSLRLSCAASGFTFTDYYMNWVRQAPGKGLEWLGFIGNKANGYTTEYSASVKGRFTISRDKSKNTLYLQMNSLRAEDTATYYCTRDRGLRFYFDYWGQGTTVTVSS

SEQ ID NO: 225 - protein, 121 aa, Artificial Sequence
  3-23A5-1C (A93T)
EVQLLESGGGLVQPGGSLRLSCAASGFTFTDYYMNWVRQAPGKGLEWVGFIGNKANGYTTEYSASVKGRFTISRDNSKNTLYLQMNSLRAEDTAVYYCTRDRGLRFYFDYWGQGTTVTVSS

SEQ ID NO: 226 - protein, 121 aa, Artificial Sequence
  3-23A5-1D (K73)
EVQLLESGGGLVQPGGSLRLSCAASGFTFTDYYMNWVRQAPGKGLEWVGFIGNKANGYTTEYSASVKGRFTISRDKSKNTLYLQMNSLRAEDTAVYYCARDRGLRFYFDYWGQGTTVTVSS

SEQ ID NO: 227 - protein, 121 aa, Artificial Sequence
  3-15A5-1
EVQLVESGGGLVKPGGSLRLSCAASGFTFTDYYMNWVRQAPGKGLEWVGFIGNKANGYTTEYSASVKGRFTISRDDSKNTLYLQMNSLKTEDTAVYYCTRDRGLRFYFDYWGQGTTVTVSS

SEQ ID NO: 228 - protein, 121 aa, Artificial Sequence
  3-15A5-2
EVQLVESGGGLVKPGGSLRLSCAASGFTFTDYYMNWVRQAPGKGLEWVGFIGNKANGYTTEYAAPVKGRFTISRDDSKNTLYLQMNSLKTEDTAVYYCTRDRGLRFYFDYWGQGTTVTVSS

SEQ ID NO: 229 - protein, 121 aa, Artificial Sequence
  3-15A5-3
EVQLVESGGGLVKPGGSLRLSCAASGFTFTDYYMNWVRQAPGKGLEWVGFIGNKANGGTTDYAAPVKGRFTISRDDSKNTLYLQMNSLKTEDTAVYYCTRDRGLRFYFDYWGQGTTVTVSS

SEQ ID NO: 230 - protein, 95 aa, Artificial Sequence
  IGKV3-11
EIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 231 - protein, 106 aa, Artificial Sequence
  A5-L1
EIVLTQSPATLSLSPGERATLSCRASSSVTYIHWYQQKPGQAPRLLIYATSNLASGIPARFSGSGSGTDFTLTISSLEPEDFAVYYCQHWSSKPPTFGQGTKLEIK

SEQ ID NO: 232 - protein, 107 aa, Artificial Sequence
  A5-L2
EIVLTQSPATLSLSPGERATLSCRASQSVSSYIHWYQQKPGQAPRLLIYATSNLASGIPARFSGSGSGTDFTLTISSLEPEDFAVYYCQHWSSKPPTFGQGTKLEIK

SEQ ID NO: 233 - protein, 106 aa, Artificial Sequence
  A5-L3
EIVLTQSPATLSLSPGERATLSCRASSSVTYIHWYQQKPGQAPRLLIYDASNRATGIPARFSGSGSGTDFTLTISSLEPEDFAVYYCQHWSSKPPTFGQGTKLEIK

SEQ ID NO: 234 - protein, 106 aa, Artificial Sequence
  A5-L4
EIVLTQSPATLSLSPGERATLSCRASSSVTYIHWYQQKPGQAPRLLIYATSNLASGIPARFSGSGSGTDFTLTISSLEPEDFAVYYCQQWSSKPPTFGQGTKLEIK

SEQ ID NO: 235 - protein, 106 aa, Artificial Sequence
  A5-L1A (all_backmutations)
QTVLTQSPATLSLSPGERATLSCRASSSVTYIHWYQQKPGSSPKSWIYATSNLASGIPARFSGSGSGTDYTLTISSLEPEDFAVYYCQHWSSKPPTFGQGTKLEIK

SEQ ID NO: 236 - protein, 106 aa, Artificial Sequence
  A5-L1B (Q1T2)
QTVLTQSPATLSLSPGERATLSCRASSSVTYIHWYQQKPGQAPRLLIYATSNLASGIPARFSGSGSGTDFTLTISSLEPEDFAVYYCQHWSSKPPTFGQGTKLEIK

SEQ ID NO: 237 - protein, 106 aa, Artificial Sequence
  A5-L1C (FR2)
EIVLTQSPATLSLSPGERATLSCRASSSVTYIHWYQQKPGSSPKSWIYATSNLASGIPARFSGSGSGTDFTLTISSLEPEDFAVYYCQHWSSKPPTFGQGTKLEIK

SEQ ID NO: 238 - protein, 428 aa, Artificial Sequence
  NABA-avi-His
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAMAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDLEVLFQGPGSGLNDIFEAQKIEWHEARAHHHHHH

SEQ ID NO: 239 - protein, 420 aa, Artificial Sequence; identical to SEQ ID NO: 169
  N(A2B2)A-avi-His

SEQ ID NO: 240 - protein, 420 aa, Artificial Sequence
  NA(B2)A-avi-His
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAMAFTCEPETQDTTYLWWINNQSLPVSPRLQLSNGNRTLTLLSVTRNDTGPYECEIQNPVSANRSDPVTLNVTYGPDDPTISPSYTYYRPGVNLSLSCHAASNPPAQYSWLIDGNIQQHTQELFISNITEKNSGLYTCQANNSASGHSRTTVKTITVSALSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDGSGLNDIFEAQKIEWHEARAHHHHHH

SEQ ID NO: 241 - DNA, 90 bp, Artificial Sequence
  A5H1EL1D_H1_rev_TN
  misc_feature (40)..(42): n is a, c, g, or t and codes for 50% N; 20% S; 3% D/E/Q/G/Y/V/T/H/A/L
  misc_feature (46)..(48): n is a, c, g, or t and codes for  50% Y; 20% A; 3.75% G/V/T/H/L/I/R/F
  misc_feature (49)..(51): n is a, c, g, or t and codes for  60% Y; 4% G/V/H/S/E/Q/N/D/R/F
  misc_feature (52)..(54): n is a, c, g, or t and codes for  50% D; 20% S; 4.3% G/Y/T/N/A/E/Q
  misc_feature (55)..(57): n is a, c, g, or t and codes for  50% T; 20% S; 4.3% A/G/Y/N/D/E/Q
  misc_feature (61)..(62): n is a, c, g, or t and codes for  60% T; 5% A/S/G/Y/N/D/E/Q
  misc_feature (63)..(63): n is a, c, g, or t
cagccactcgaggcctttacccggtgcttggcgtacccannncatnnnnnnnnnnnngaannngaagccagaagccgcgcagctgagacg

SEQ ID NO: 242 - DNA, 84 bp, Artificial Sequence
  A5H1EL1D_H2_for_TN
  misc_feature (37)..(39): n is a, c, g, or t and codes for  60% F; 10% A; 6 % Y/V/L/I/G
  misc_feature (43)..(45): n is a, c, g, or t and codes for  50% G; 20% S; 3% A/K/T/V/N/D/E/Q/L/I
  misc_feature (46)..(48): n is a, c, g, or t and codes for  650% N; 20% G; 3.75 % D/E/Q/S/Y/T/H/A
  misc_feature (49)..(51): n is a, c, g, or t and codes for  60% K; 5% A/T/Y/N/D/E/Q/R
  misc_feature (52)..(54): n is a, c, g, or t and codes for  60% A; 4% V/G/D/P/H/N/E/Q/L/I
  misc_feature (55)..(57): n is a, c, g, or t and codes for  60% N; 5% D/E/Q; 4.17% G/T/H/S/A/R
cgccaagcaccgggtaaaggcctcgagtggctgggtnnnatcnnnnnnnnnnnnnnngcgtacaccacggaatactccgcctcc

SEQ ID NO: 243 - DNA, 26 bp, Artificial Sequence
  LMB3 long
caggaaacagctatgaccatgattac

SEQ ID NO: 244 - DNA, 53 bp, Artificial Sequence
  HCDR3-rev-constant
aacggtcaccgtggtaccctggccccagtagtcgaaatagaagcgcagaccac

SEQ ID NO: 245 - DNA, 84 bp, Artificial Sequence
  A5H1EL1D _L1_rev_TN
  misc_feature (37)..(39): n is a, c, g, or t and codes for 50% H; 20% A; 3.33% R/K/G/S/T/Q/Y/N/V
  misc_feature (40)..(42): n is a, c, g, or t and codes for 70% I; 30% L
  misc_feature (43)..(45): n is a, c, g, or t and codes for  60% Y; 4% F/G/A/V/T/H/S/N/Q/R
  misc_feature (46)..(48): n is a, c, g, or t and codes for  50% T; 20% S; 2.72% A/G/Y/V/P/H/N/D/E/Q/R
  misc_feature (49)..(51): n is a, c, g, or t and codes for 50% V; 20% S; 3.33% T/A/G/N/Q/F/Y/P/H
  misc_feature (52)..(54): n is a, c, g, or t and codes for 50% S; 20% V; 3.33% T/A/G/N/D/E/Q/Y/H
ggaacgcggggcctggcctggtttttgctgataccannnnnnnnnnnnnnnnnngctggatgcgcggcaagacagggtagcacg

SEQ ID NO: 246 - DNA, 84 bp, Artificial Sequence
  A5H1EL1D _L2_for_TN
  misc_feature (37)..(39): n is a, c, g, or t and codes for  60% Y; 10% F; 7.5% H/K/N/S
  misc_feature (40)..(42): n is a, c, g, or t and codes for  50% A; 20% D; 3.33% V/G/S/T/Y/H/N/E/Q
  misc_feature (43)..(45): n is a, c, g, or t and codes for  50% T; 20% A; 3.33% S/G/V/P/H/N/D/E/Q
  misc_feature (46)..(48): n is a, c, g, or t and codes for  60% S; 4% T/A/G/N/D/E/Q/Y/V/H
  misc_feature (49)..(51): n is a, c, g, or t and codes for  60% N; 4% D/E/Q/Y/K/T/H/S/A/R
cagcaaaaaccaggccaggccccgcgttcctggatcnnnnnnnnnnnnnnnctcgcttctggtatcccggcacgtttctccggc

SEQ ID NO: 247 - DNA, 84 bp, Artificial Sequence
  A5H1EL1D _L3_for_TN
  misc_feature (31)..(33): n is a, c, g, or t and codes for  90% Q; 10% H
  misc_feature (34)..(36): n is a, c, g, or t and codes for  60% H; 5% R/K/Q/E/Y/F/N/D
  misc_feature (37)..(39): n is a, c, g, or t and codes for 65% W; 7% F/Y/V/L/I
  misc_feature (40)..(42): n is a, c, g, or t and codes for  58% S; 4% T/A/G/N/D/E/Q; 2% Y/V/P/H/L/I/R
  misc_feature (43)..(45): n is a, c, g, or t and codes for  58% S; 4% T/A/G/N/D/E/Q; 2% Y/V/P/H/L/I/R
  misc_feature (46)..(48): n is a, c, g, or t and codes for  60% K; 5% R/H; 2.72% A/V/T/P/Y/N/D/E/Q/L/I
  misc_feature (49)..(51): n is a, c, g, or t and codes for  70% P; 5% A/S/T/R/S/L
  misc_feature (52)..(54): n is a, c, g, or t and codes for 60% P; 5% L/G/R/M; 2.86% A/V/L/I/F/S/R
gagcctgaagattttgccgtatactattgtnnnnnnnnnnnnnnnnnnnnnnnnactttcggtcagggcaccaagctggaaatc

SEQ ID NO: 248 - DNA, 90 bp, Artificial Sequence
  A5H1EL1D _H3_rev_TN
  misc_feature (34)..(36): n is a, c, g, or t and codes for  80% F; 10% I/L
  misc_feature (37)..(39): n is a, c, g or t and codes for  60% Y; 5% F/W; 2.14% G/A/V/T/P/H/S/N/D/E/Q/L/I/R
  misc_feature (40)..(42): n is a, c, g, or t and codes for  65% F; 5% Y/W/A/V/L/I/G
  misc_feature (43)..(45): n is a, c, g or t and codes for 60% R; 5% K/H; 2.72% A/V/T/P/Y/N/D/E/Q/L/I
  misc_feature (46)..(48): n is a, c, g, or t and codes for 60% L; 4% I/V/A/F; 2.4% G/Y/T/P/H/S/N/D/E/Q
  misc_feature (49)..(51): n is a, c, g, or t and codes for 60% G; 5% A/S/T; 2.5% Y/V/P/H/N/D/E/Q/L/I
  misc_feature (52)..(54): n is a, c, g, or t and codes for  60% R; 5% K/H; 2.72% A/V/T/P/Y/N/D/E/Q/L/I
  misc_feature (55)..(57): n is a, c, g, or t
  misc_feature (58)..(60): n is a, c, g, or t and codes for  80% F; 10% I/L
  misc_feature (58)..(60): n is a, c, g, or t and codes for  60% R; 10% K; 2.72% A/V/T/P/Y/N/D/E/Q/L/H
aacggtcaccgtggtaccctggccccagtagtcnnnnnnnnnnnnnnnnnnnnnnnnnnnagtacagtagtaggtggcggtgtcttctgc

SEQ ID NO: 249 - DNA, 30 bp, Artificial Sequence
  LCDR3-rev-constant
acaatagtatacggcaaaatcttcaggctc

SEQ ID NO: 250 - DNA, 36 bp, Artificial Sequence
  HCDR3 amplification
agaaacggtcaccgtggtaccctggccccagtagtc

SEQ ID NO: 251 - protein, 10 aa, Artificial Sequence
  CEA (P006.038)- CDR-H1
GFTFTDYYMN

SEQ ID NO: 252 - protein, 19 aa, Artificial Sequence
  CEA (P006.038)- CDR-H2
FIGNKANAYTTEYSASVKG

SEQ ID NO: 253 - protein, 10 aa, Artificial Sequence
  CEA (P006.038)- CDR-H3
DRGIRFGFDY

SEQ ID NO: 254 - protein, 10 aa, Artificial Sequence
  CEA (P006.038)- CDR-L1
RASSSVTYIH

SEQ ID NO: 255 - protein, 7 aa, Artificial Sequence
  CEA (P006.038)- CDR-L2
ATSNLAS

SEQ ID NO: 256 - protein, 9 aa, Artificial Sequence
  CEA (P006.038)- CDR-L3
QHWSSVPPT

SEQ ID NO: 257 - protein, 10 aa, Artificial Sequence
  CEA (P005.097)- CDR-H1
GFTFTDYYMN

SEQ ID NO: 258 - protein, 19 aa, Artificial Sequence
  CEA (P005.097)- CDR-H2
FIGNKANAYTTEYSASVKG

SEQ ID NO: 259 - protein, 10 aa, Artificial Sequence
  CEA (P005.097)- CDR-H3
DRGLRFSFDY

SEQ ID NO: 260 - protein, 10 aa, Artificial Sequence
  CEA (P005.097)- CDR-L1
RASSSVTYIH

SEQ ID NO: 261 - protein, 7 aa, Artificial Sequence
  CEA (P005.097)- CDR-L2
ATSNLAS

SEQ ID NO: 262 - protein, 9 aa, Artificial Sequence
  CEA (P005.097)- CDR-L3
QHWSSQPPT

SEQ ID NO: 263 - protein, 10 aa, Artificial Sequence
  CEA (P005.103)- CDR-H1
GFTFTDYYMN

SEQ ID NO: 264 - protein, 19 aa, Artificial Sequence
  CEA (P005.103)- CDR-H2
FIGNKANAYTTEYSASVKG

SEQ ID NO: 265 - protein, 10 aa, Artificial Sequence
  CEA (P005.103)- CDR-H3
DRGIRFYFDY

SEQ ID NO: 266 - protein, 10 aa, Artificial Sequence
  CEA (P005.103)- CDR-L1
RASSSVTYIH

SEQ ID NO: 267 - protein, 7 aa, Artificial Sequence
  CEA (P005.103)- CDR-L2
ATSNLAS

SEQ ID NO: 268 - protein, 9 aa, Artificial Sequence
  CEA (P005.103)- CDR-L3
QHWSSISPT

SEQ ID NO: 269 - protein, 10 aa, Artificial Sequence
  CEA (P002.139)- CDR-H1
GFYFTDYAMN

SEQ ID NO: 270 - protein, 19 aa, Artificial Sequence
  CEA (P002.139)- CDR-H2
VISNKANAYTTEYSASVKG

SEQ ID NO: 271 - protein, 10 aa, Artificial Sequence
  CEA (P002.139)- CDR-H3
DRGLRFYFDY

SEQ ID NO: 272 - protein, 10 aa, Artificial Sequence
  CEA (P002.139)- CDR-L1
HASSSVTYIH

SEQ ID NO: 273 - protein, 7 aa, Artificial Sequence
  CEA (P002.139)- CDR-L2
ATSNLAS

SEQ ID NO: 274 - protein, 9 aa, Artificial Sequence
  CEA (P002.139)- CDR-L3
QHWSSKPPT

SEQ ID NO: 275 - protein, 10 aa, Artificial Sequence
  CEA (P001.177)- CDR-H1
GFYFTDYYMN

SEQ ID NO: 276 - protein, 19 aa, Artificial Sequence
  CEA (P001.177)- CDR-H2
FISNKANAYTTEYSASVKG

SEQ ID NO: 277 - protein, 10 aa, Artificial Sequence
  CEA (P001.177)- CDR-H3
DRGLRFYFDY

SEQ ID NO: 278 - protein, 10 aa, Artificial Sequence
  CEA (P001.177)- CDR-L1
RASSSVTYIH

SEQ ID NO: 279 - protein, 7 aa, Artificial Sequence
  CEA (P001.177)- CDR-L2
ATSNLAS

SEQ ID NO: 280 - protein, 9 aa, Artificial Sequence
  CEA (P001.177)- CDR-L3
QHWSSKPPT

SEQ ID NO: 281 - protein, 10 aa, Artificial Sequence
  CEA (P005.102)- CDR-H1
GFTFTDYYMN

SEQ ID NO: 282 - protein, 19 aa, Artificial Sequence
  CEA (P005.102)- CDR-H2
FIGNKANAYTTEYSASVKG

SEQ ID NO: 283 - protein, 10 aa, Artificial Sequence
  CEA (P005.102)- CDR-H3
DRGIRFQFDY

SEQ ID NO: 284 - protein, 10 aa, Artificial Sequence
  CEA (P005.102)- CDR-L1
RASSSVTYIH

SEQ ID NO: 285 - protein, 7 aa, Artificial Sequence
  CEA (P005.102)- CDR-L2
ATSNLAS

SEQ ID NO: 286 - protein, 9 aa, Artificial Sequence
  CEA (P005.102)- CDR-L3
QHWSSKSPT

SEQ ID NO: 287 - protein, 10 aa, Artificial Sequence
  CEA (P005.102-combo1)- CDR-H1
GFYFTDYYMN

SEQ ID NO: 288 - protein, 19 aa, Artificial Sequence
  CEA (P005.102-combo1)- CDR-H2
VISNKANAYTTEYSASVKG

SEQ ID NO: 289 - protein, 10 aa, Artificial Sequence
  CEA (P005.102-combo1)- CDR-H3
DRGIRFQFDY

SEQ ID NO: 290 - protein, 10 aa, Artificial Sequence
  CEA (P005.102-combo1)- CDR-L1
RASSSVTYIH

SEQ ID NO: 291 - protein, 7 aa, Artificial Sequence
  CEA (P005.102-combo1)- CDR-L2
ATSNLAS

SEQ ID NO: 292 - protein, 9 aa, Artificial Sequence
  CEA (P005.102-combo1)- CDR-L3
QHWSSKSPT

SEQ ID NO: 293 - protein, 10 aa, Artificial Sequence
  CEA (P005.102-combo2)- CDR-H1
GFYFSDYYMN

SEQ ID NO: 294 - protein, 19 aa, Artificial Sequence
  CEA (P005.102-combo2)- CDR-H2
VISNKANAYTTEYSASVKG

SEQ ID NO: 295 - protein, 10 aa, Artificial Sequence
  CEA (P005.102-combo2)- CDR-H3
DRGIRFQFDY

SEQ ID NO: 296 - protein, 10 aa, Artificial Sequence
  CEA (P005.102-combo2)- CDR-L1
RASSSVTYIH

SEQ ID NO: 297 - protein, 7 aa, Artificial Sequence
  CEA (P005.102-combo2)- CDR-L2
ATSNLAS

SEQ ID NO: 298 - protein, 9 aa, Artificial Sequence
  CEA (P005.102-combo2)- CDR-L3
QHWSSKSPT

SEQ ID NO: 299 - protein, 10 aa, Artificial Sequence
  CEA (P005.103-combo1)- CDR-H1
GFTFTDYYMN

SEQ ID NO: 300 - protein, 19 aa, Artificial Sequence
  CEA (P005.103-combo1)- CDR-H2
FIGNKANAYTTEYSASVKG

SEQ ID NO: 301 - protein, 10 aa, Artificial Sequence
  CEA (P005.103-combo1)- CDR-H3
DRGIRFSFDY

SEQ ID NO: 302 - protein, 10 aa, Artificial Sequence
  CEA (P005.103-combo1)- CDR-L1
RASSSVTYIH

SEQ ID NO: 303 - protein, 7 aa, Artificial Sequence
  CEA (P005.103-combo1)- CDR-L2
ATSNLAS

SEQ ID NO: 304 - protein, 9 aa, Artificial Sequence
  CEA (P005.103-combo1)- CDR-L3
QHWSSISPT

SEQ ID NO: 305 - protein, 10 aa, Artificial Sequence
  CEA (P005.103-combo2)- CDR-H1
GFYFTDYYMN

SEQ ID NO: 306 - protein, 19 aa, Artificial Sequence
  CEA (P005.103-combo2)- CDR-H2
VISNKANAYTTEYSASVKG

SEQ ID NO: 307 - protein, 10 aa, Artificial Sequence
  CEA (P005.103-combo2)- CDR-H3
DRGIRFSFDY

SEQ ID NO: 308 - protein, 10 aa, Artificial Sequence
  CEA (P005.103-combo2)- CDR-L1
RASSSVTYIH

SEQ ID NO: 309 - protein, 7 aa, Artificial Sequence
  CEA (P005.103-combo2)- CDR-L2
ATSNLAS

SEQ ID NO: 310 - protein, 9 aa, Artificial Sequence
  CEA (P005.103-combo2)- CDR-L3
QHWSSISPT

SEQ ID NO: 311 - protein, 10 aa, Artificial Sequence
  CEA (P006.038-combo1)- CDR-H1
GFYFTDYAMN

SEQ ID NO: 312 - protein, 19 aa, Artificial Sequence
  CEA (P006.038-combo1)- CDR-H2
VISNKANAYTTEYSASVKG

SEQ ID NO: 313 - protein, 10 aa, Artificial Sequence
  CEA (P006.038-combo1)- CDR-H3
DRGIRFGFDY

SEQ ID NO: 314 - protein, 10 aa, Artificial Sequence
  CEA (P006.038-combo1)- CDR-L1
RASSSVTYIH

SEQ ID NO: 315 - protein, 7 aa, Artificial Sequence
  CEA (P006.038-combo1)- CDR-L2
ATSNLAS

SEQ ID NO: 316 - protein, 9 aa, Artificial Sequence
  CEA (P006.038-combo1)- CDR-L3
QHWSSVPPT

SEQ ID NO: 317 - protein, 10 aa, Artificial Sequence
  CEA (P006.038-combo2)- CDR-H1
GFTFSDYEMN

SEQ ID NO: 318 - protein, 19 aa, Artificial Sequence
  CEA (P006.038-combo2)- CDR-H2
FISNKANAYTTEYSASVKG

SEQ ID NO: 319 - protein, 10 aa, Artificial Sequence
  CEA (P006.038-combo2)- CDR-H3
DRGIRFGFDY

SEQ ID NO: 320 - protein, 10 aa, Artificial Sequence
  CEA (P006.038-combo2)- CDR-L1
RASSSVTYIH

SEQ ID NO: 321 - protein, 7 aa, Artificial Sequence
  CEA (P006.038-combo2)- CDR-L2
ATSNLAS

SEQ ID NO: 322 - protein, 9 aa, Artificial Sequence
  CEA (P006.038-combo2)- CDR-L3
QHWSSVPPT

SEQ ID NO: 323 - protein, 449 aa, Artificial Sequence
  VL CEA (A5H1EL1D) -CH1- Fc hole PGLALA
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 324 - protein, 213 aa, Artificial Sequence
  VH CEA (A5H1EL1D) - CL
EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 325 - protein, 436 aa, Artificial Sequence
  VL CEA (P006.038) -CH1- Fc hole PGLALA
EIVLTQSPATLSLSPGERATLSCRASSSVTYIHWYQQKPGQAPRSWIYATSNLASGIPARFSGSGSGTDFTLTISSLEPEDFAVYYCQHWSSVPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 326 - protein, 228 aa, Artificial Sequence
  VH CEA (P006.038) - CL
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFGFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 436 aa, Artificial Sequence
  VL CEA (P005.097) -CH1- Fc hole PGLALA
EIVLTQSPATLSLSPGERATLSCRASSSVTYIHWYQQKPGQAPRSWIYATSNLASGIPARFSGSGSGTDFTLTISSLEPEDFAVYYCQHWSSQPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 328 - protein, 228 aa, Artificial Sequence
  VH CEA (P005.097) - CL
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFSFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 436 aa, Artificial Sequence
  VL CEA (P005.103) -CH1- Fc hole PGLALA
EIVLTQSPATLSLSPGERATLSCRASSSVTYIHWYQQKPGQAPRSWIYATSNLASGIPARFSGSGSGTDFTLTISSLEPEDFAVYYCQHWSSISPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 330 - protein, 228 aa, Artificial Sequence
  VH CEA (P005.103) - CL
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 436 aa, Artificial Sequence
  VL CEA (P002.139) -CH1- Fc hole PGLALA
EIVLTQSPATLSLSPGERATLSCHASSSVTYIHWYQQKPGQAPRSWIYATSNLASGIPARFSGSGSGTDFTLTISSLEPEDFAVYYCQHWSSKPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 332 - protein, 228 aa, Artificial Sequence
  VH CEA (P002.139) - CL
EVQLLESGGGLVQPGGSLRLSCAASGFYFTDYAMNWVRQAPGKGLEWLGVISNKANAYTTEYSASVKGRFTISRDKSKNTLYLQMNSLRAEDTATYYCTRDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 436 aa, Artificial Sequence
  VL CEA (P001.177) -CH1- Fc hole PGLALA
EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 334 - protein, 228 aa, Artificial Sequence
  VH CEA (P001.177) - CL
EVQLLESGGGLVQPGGSLRLSCAASGFYFTDYYMNWVRQAPGKGLEWLGFISNKANAYTTEYSASVKGRFTISRDKSKNTLYLQMNSLRAEDTATYYCTRDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 436 aa, Artificial Sequence
  VL CEA (P005.102) -CH1- Fc hole PGLALA
EIVLTQSPATLSLSPGERATLSCRASSSVTYIHWYQQKPGQAPRSWIYATSNLASGIPARFSGSGSGTDFTLTISSLEPEDFAVYYCQHWSSKSPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 336 - protein, 228 aa, Artificial Sequence
  VH CEA (P005.102) - CL
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFQFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 436 aa, Artificial Sequence; identical to SEQ ID NO: 335
  VL CEA (P005.102 combo1) -CH1- Fc hole PGLALA

SEQ ID NO: 338 - protein, 228 aa, Artificial Sequence
  VH CEA (P005.102 combo1) - CL
EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFQFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 436 aa, Artificial Sequence; identical to SEQ ID NO: 335
  VL CEA (P005.102 combo2) -CH1- Fc hole PGLALA

SEQ ID NO: 340 - protein, 228 aa, Artificial Sequence
  VH CEA (P005.102 combo2) - CL
EVQLLESGGGLVQPGGSLRLSCAASGFYFSDYYMNWVRQAPGKGLEWLGVISNKANAYTTEYSASVKGRFTISRDKSKNTLYLQMNSLRAEDTATYYCTRDRGIRFQFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - protein, 436 aa, Artificial Sequence; identical to SEQ ID NO: 329
  VL CEA (P005.103 combo1) -CH1- Fc hole PGLALA

SEQ ID NO: 342 - protein, 228 aa, Artificial Sequence
  VH CEA (P005.103 combo1) - CL
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGIRFSFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 343 - protein, 436 aa, Artificial Sequence; identical to SEQ ID NO: 329
  VL CEA (P005.103 combo2) -CH1- Fc hole PGLALA

SEQ ID NO: 344 - protein, 228 aa, Artificial Sequence
  VH CEA (P005.103 combo2) - CL
EVQLLESGGGLVQPGGSLRLSCAASGFYFTDYYMNWVRQAPGKGLEWLGVISNKANAYTTEYSASVKGRFTISRDKSKNTLYLQMNSLRAEDTATYYCTRDRGIRFSFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - protein, 436 aa, Artificial Sequence; identical to SEQ ID NO: 325
  VL CEA (P006.038 combo1) -CH1- Fc hole PGLALA

SEQ ID NO: 346 - protein, 228 aa, Artificial Sequence
  VH CEA (P006.038 combo1) - CL
EVQLLESGGGLVQPGGSLRLSCAASGFYFTDYAMNWVRQAPGKGLEWLGVISNKANAYTTEYSASVKGRFTISRDKSKNTLYLQMNSLRAEDTATYYCTRDRGIRFGFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 436 aa, Artificial Sequence; identical to SEQ ID NO: 325
  VL CEA (P006.038 combo2) -CH1- Fc hole PGLALA

SEQ ID NO: 348 - protein, 228 aa, Artificial Sequence
  VH CEA (P006.038 combo2) - CL
EVQLLESGGGLVQPGGSLRLSCAASGFTFSDYEMNWVRQAPGKGLEWLGFISNKANAYTTEYSASVKGRFTISRDKSKNTLYLQMNSLRAEDTATYYCTRDRGIRFGFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 349 - protein, 448 aa, Artificial Sequence; identical to SEQ ID NO: 116
  VH CD28 (SA_Variant 15) - CH1- Fc knob PGLALA

SEQ ID NO: 350 - protein, 214 aa, Artificial Sequence; identical to SEQ ID NO: 121
  VL CD28 (SA_Variant 15) - CL

SEQ ID NO: 351 - protein, 436 aa, Artificial Sequence; identical to SEQ ID NO: 333
  CEA(A5H1EL1D) VL-CH1 hu IgG1 Fc hole PGLALA

SEQ ID NO: 352 - protein, 228 aa, Artificial Sequence
  CEA(A5H1EL1D) VH-Ckappa
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 353 - protein, 448 aa, Artificial Sequence; identical to SEQ ID NO: 66
  CD28(SA) hu IgG1 VH-CH1 "EE" Fc knob PGLALA

SEQ ID NO: 354 - protein, 214 aa, Artificial Sequence; identical to SEQ ID NO: 65
  CD28(SA) hu IgG1 VL-Ck "RK"

SEQ ID NO: 355 - protein, 448 aa, Artificial Sequence; identical to SEQ ID NO: 114
  CD28(SA_Variant 8) hu IgG1 VH-CH1 "EE" Fc knob PGLALA

SEQ ID NO: 356 - protein, 214 aa, Artificial Sequence; identical to SEQ ID NO: 122
  CD28(SA_Variant 8) hu IgG1 VL-Ck "RK"

SEQ ID NO: 357 - protein, 448 aa, Artificial Sequence; identical to SEQ ID NO: 116
  CD28(SA_Variant 15) hu IgG1 VH-CH1 "EE" Fc knob PGLALA

SEQ ID NO: 358 - protein, 214 aa, Artificial Sequence; identical to SEQ ID NO: 121
  CD28(SA_Variant 15) hu IgG1 VL-Ck "RK"

SEQ ID NO: 359 - protein, 448 aa, Artificial Sequence; identical to SEQ ID NO: 118
  CD28(SA_Variant 29) hu IgG1 VH-CH1 "EE" Fc knob PGLALA

SEQ ID NO: 360 - protein, 449 aa, Artificial Sequence
  CEA(A5H1EL1D) hu IgG1 VH-CH1 "EE" Fc hole PGLALA
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 361 - protein, 213 aa, Artificial Sequence
  CEA(A5H1EL1D) hu IgG1 VL-Ck "RK"
EIVLTQSPATLSLSPGERATLSCRASSSVTYIHWYQQKPGQAPRSWIYATSNLASGIPARFSGSGSGTDFTLTISSLEPEDFAVYYCQHWSSKPPTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - protein, 437 aa, Artificial Sequence
  CD28(SA) VL-CH1 hu IgG1 Fc knob PGLALA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 363 - protein, 227 aa, Artificial Sequence; identical to SEQ ID NO: 77
  CD28(SA) VH-Ckappa

SEQ ID NO: 364 - protein, 437 aa, Artificial Sequence
  CD28(SA_Variant 8) VL-CH1 hu IgG1 Fc knob PGLALA
DIQMTQSPSSLSASVGDRVTITCHASQNIYVYLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 365 - protein, 227 aa, Artificial Sequence
  CD28(SA_Variant 8) VH-Ckappa
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDFNFDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 437 aa, Artificial Sequence
  CD28(SA_Variant 15) VL-CH1 hu IgG1 Fc knob PGLALA
DIQMTQSPSSLSASVGDRVTITCHASQNIYVFLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 367 - protein, 227 aa, Artificial Sequence
  CD28(SA_Variant 15) VH-Ckappa
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDWNFDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 368 - protein, 227 aa, Artificial Sequence
  CD28(SA_Variant 29) VH-Ckappa
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 369 - protein, 441 aa, Artificial Sequence
  CEA(T84.66) VL-CH1 hu IgG1 Fc hole PGLALA
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 370 - protein, 228 aa, Artificial Sequence
  CEA(T84.66) VH-Ckappa
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 449 aa, Artificial Sequence; identical to SEQ ID NO: 166
  CEA(T84.66) hu IgG1 VH-CH1 "EE" Fc hole PGLALA

SEQ ID NO: 372 - protein, 218 aa, Artificial Sequence; identical to SEQ ID NO: 168
  CEA(T84.66) hu IgG1 VL-Ck "RK"

SEQ ID NO: 373 - protein, 684 aa, Artificial Sequence
  CEA(A5H1EL1D) VH-CH1-VH-CH1 "EE" hu IgG1 Fc hole PGLALA
EVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 374 - protein, 672 aa, Artificial Sequence
  CD28(SA) VL-CH1 CEA(A5H1EL1D) VH-CH1 "EE" hu IgG1 Fc knob PGLALA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFTDYYMNWVRQAPGKGLEWLGFIGNKANAYTTEYSASVKGRFTISRDKSKNTLYLQMNSLRAEDTATYYCTRDRGLRFYFDYWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 375 - protein, 436 aa, Artificial Sequence; identical to SEQ ID NO: 333
  CEA(P002.139) VL-CH1 hu IgG1 Fc hole PGLALA

SEQ ID NO: 376 - protein, 228 aa, Artificial Sequence; identical to SEQ ID NO: 352
  CEA(P002.139) VH-Ckappa

SEQ ID NO: 377 - protein, 214 aa, Artificial Sequence
  CD28 (SA_Variant 8) hu IgG1 light chain
DIQMTQSPSSLSASVGDRVTITCHASQNIYVYLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 378 - protein, 448 aa, Artificial Sequence
  CD28(SA_Variant 8) hu IgG1 PGLALA heavy chain
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDFNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 379 - protein, 214 aa, Artificial Sequence; identical to SEQ ID NO: 62
  CD28 (SA_Variant 11) hu IgG1 light chain

SEQ ID NO: 380 - protein, 448 aa, Artificial Sequence; identical to SEQ ID NO: 378
  CD28 (SA_Variant 11) hu IgG1 PGLALA heavy chain

SEQ ID NO: 381 - protein, 214 aa, Artificial Sequence
  CD28 (SA_Variant 15) hu IgG1 light chain
DIQMTQSPSSLSASVGDRVTITCHASQNIYVFLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 448 aa, Artificial Sequence
  CD28 (SA_Variant 15) hu IgG1 PGLALA heavy chain
QVQLVQSGAEVKKPGASVKVSCKASGYTFTSYYIHWVRQAPGQGLEWIGSIYPGNVQTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 383 - protein, 214 aa, Artificial Sequence
  CD28 (SA_Variant 27) hu IgG1 light chain
DIQMTQSPSSLSASVGDRVTITCHASQGIYVYLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 384 - protein, 448 aa, Artificial Sequence
  CD28(SA_Variant 27) hu IgG1 PGLALA heavy chain
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 385 - protein, 214 aa, Artificial Sequence; identical to SEQ ID NO: 62
  CD28 (SA_Variant 29) hu IgG1 light chain

SEQ ID NO: 386 - protein, 448 aa, Artificial Sequence; identical to SEQ ID NO: 384
  CD28 (SA_Variant 29) hu IgG1 PGLALA heavy chain

SEQ ID NO: 387 - protein, 15 aa, Artificial Sequence
  Avi tag
GLNDIFEAQKIEWHE

SEQ ID NO: 388 - protein, 679 aa, Artificial Sequence
  CD28 VHCH1 "EE"-(G4S)2- FAP (4B9)-VHCH1 "EE" - Fc knob PGLALA
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 389 - protein, 439 aa, Artificial Sequence
  CD28 VLCL "RK"-(G4S)2- FAP (4B9)-VLCL "RK"
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 455 aa, Artificial Sequence
  EpCAM (MT201) hu IgG1 VH-CH1 "EE" Fc hole PGLALA
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 391 - protein, 214 aa, Artificial Sequence
  EpCAM(MT201) VL-Ckappa "RK"
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 443 aa, Artificial Sequence
  HER3 VL-CH1 hu IgG1 Fc hole PGLALA
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 393 - protein, 227 aa, Artificial Sequence
  HER3 VH-Ckappa
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 441 aa, Artificial Sequence
  CD30 VL-CH1 hu IgG1 Fc hole PGLALA
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 395 - protein, 224 aa, Artificial Sequence
  CD30 VH-Ckappa
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSAASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 437 aa, Artificial Sequence
  TPBG VL-CH1 hu IgG1 Fc hole PGLALA
DIQMTQSPSSLSASVGDRVTITCQASQDISNYLNWYQQKPGKAPKLLIYAASTLQIGVPSRFSGSGSGTDFTFTISSLQPEDFATYYCQQANSFPLTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 397 - protein, 231 aa, Artificial Sequence
  TPBG VH-Ckappa
EVHLLESGGGLVHPGGSLRLSCAASGFTFRSDAMHWVRQAPGKGLEWVSGVSGSGGSPYYADSVKGRFTISRDDSKTTLYLQMNSLRAEDTAVYYCATGGSIAGSYYYYPMDVWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 398 - protein, 445 aa, Artificial Sequence
  GPRC5D (5E11) hu IgG1 VH-CH1 "EE" Fc hole PGLALA
EVQLLESGGGLVQPGGSLRLSCAASGFTFSKYAMAWVRQAPGKGLEWVASISTGGVNTYYADSVKGRFTISRDNSKNTLYLQMNSLRAEDTAVYYCATHTGDYFDYWGQGTMVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 399 - protein, 218 aa, Artificial Sequence
  GPRC5D (5E11)VL-Ckappa "RK"
EIVLTQSPGTLSLSPGERATLSCRASQSVSISGINLMNWYQQKPGQQPKLLIYHASILASGIPDRFSGSGSGTDFTLTISRLEPEDFAVYYCQQTRESPLTFGQGTRLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 400 - protein, 437 aa, Artificial Sequence
  CD38 VL-CH1 hu IgG1 Fc hole PGLALA
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 401 - protein, 229 aa, Artificial Sequence
  CD38 VH-Ckappa
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 443 aa, Artificial Sequence
  BCMA hu IgG1 VH-CH1 "EE" Fc hole PGLALA
EVQLLESGGGLVQPGGSLRLSCAASGFTFSSYAMNWVRQAPGKGLEWVSAITASGGSTYYADSVKGRFTISRDNSKNTLYLQMNSLRAEDTAVYYCARYWPMSLWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 403 - protein, 215 aa, Artificial Sequence
  BCMA VL-Ckappa "RK"
EIVLTQSPGTLSLSPGERATLSCRASQSVSAYYLAWYQQKPGQAPRLLMYDASIRATGIPDRFSGSGSGTDFTLTISRLEPEDFAVYYCQQYERWPLTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - protein, 670 aa, Artificial Sequence
  GPRC5D (5E11) VH-CH1(EE)-CD3 VL-CH1-Fc (knob, P329G LALA) (GPRC5D TCB)
EVQLLESGGGLVQPGGSLRLSCAASGFTFSKYAMAWVRQAPGKGLEWVASISTGGVNTYYADSVKGRFTISRDNSKNTLYLQMNSLRAEDTAVYYCATHTGDYFDYWGQGTMVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 405 - protein, 232 aa, Artificial Sequence
  CD3 VH-CL (GPRC5D TCB)
EVQLLESGGGLVQPGGSLRLSCAASGFQFSSYAMNWVRQAPGKGLEWVSRIRSKYNNYATYYADSVKGRFTISRDDSKNTLYLQMNSLRAEDTAVYYCVRHTTFPSSYVSYYGYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 5 aa, Artificial Sequence
  CD19 (8B8-2B11) CDR-H1
DYIMH

SEQ ID NO: 407 - protein, 17 aa, Artificial Sequence
  CD19 (8B8-2B11) CDR-H2
YINPYNDGSKYTEKFQG

SEQ ID NO: 408 - protein, 12 aa, Artificial Sequence
  CD19 (8B8-2B11) CDR-H3
GTYYYGPQLFDY

SEQ ID NO: 409 - protein, 16 aa, Artificial Sequence
  CD19 (8B8-2B11) CDR-L1
KSSQSLETSTGTTYLN

SEQ ID NO: 410 - protein, 7 aa, Artificial Sequence
  CD19 (8B8-2B11) CDR-L2
RVSKRFS

SEQ ID NO: 411 - protein, 9 aa, Artificial Sequence
  CD19 (8B8-2B11) CDR-L3
LQLLEDPYT

SEQ ID NO: 412 - protein, 121 aa, Artificial Sequence
  CD19 (8B8-2B11) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 413 - protein, 112 aa, Artificial Sequence
  CD19 (8B8-2B11) VL
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 414 - protein, 5 aa, Artificial Sequence
  CD19 (8B8-018) CDR-H1
DYIMH

SEQ ID NO: 415 - protein, 17 aa, Artificial Sequence
  CD19 (8B8-018) CDR-H2
YINPYNDGSKYTEKFQG

SEQ ID NO: 416 - protein, 12 aa, Artificial Sequence
  CD19 (8B8-018) CDR-H3
GTYYYGSALFDY

SEQ ID NO: 417 - protein, 16 aa, Artificial Sequence
  CD19 (8B8-018) CDR-L1
KSSQSLENPNGNTYLN

SEQ ID NO: 418 - protein, 7 aa, Artificial Sequence
  CD19 (8B8-018) CDR-L2
RVSKRFS

SEQ ID NO: 419 - protein, 9 aa, Artificial Sequence
  CD19 (8B8-018) CDR-L3
LQLTHVPYT

SEQ ID NO: 420 - protein, 121 aa, Artificial Sequence
  CD19 (8B8-018) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 421 - protein, 112 aa, Artificial Sequence
  CD19 (8B8-018) VL
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 422 - protein, 5 aa, Artificial Sequence
  CD79b (huMA79b.v28) CDR-H1
SYWIE

SEQ ID NO: 423 - protein, 17 aa, Artificial Sequence
  CD79b (huMA79b.v28) CDR-H2
EILPGGGDTNYNEIFKG

SEQ ID NO: 424 - protein, 8 aa, Artificial Sequence
  CD79b (huMA79b.v28) CDR-H3
RVPIRLDY

SEQ ID NO: 425 - protein, 15 aa, Artificial Sequence
  CD79b (huMA79b.v28) CDR-L1
KASQSVDYEGDSFLN

SEQ ID NO: 426 - protein, 7 aa, Artificial Sequence
  CD79b (huMA79b.v28) CDR-L2
AASNLES

SEQ ID NO: 427 - protein, 9 aa, Artificial Sequence
  CD79b (huMA79b.v28) CDR-L3
QQSNEDPLT

SEQ ID NO: 428 - protein, 117 aa, Artificial Sequence [sequence omitted]

SEQ ID NO: 429 - protein, 111 aa, Artificial Sequence [sequence omitted]

SEQ ID NO: 430 - protein, 442 aa, Artificial Sequence
  VL (CD19 2B11) -CH1 Fc hole PGLALA
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 431 - protein, 228 aa, Artificial Sequence
  VH (CD19 2B11) CL
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 432 - protein, 441 aa, Artificial Sequence
  VL (huMA79b.v28) -CH1 Fc hole PGLALA
DIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 433 - protein, 224 aa, Artificial Sequence
  VH (huMA79b.v28) CL
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 434 - protein, 556 aa, Homo sapiens [sequence omitted]

SEQ ID NO: 435 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 436 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 437 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 438 - protein, 281 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 439 - protein, 5 aa, Artificial Sequence
  CD3-HCDR1
TYAMN

SEQ ID NO: 440 - protein, 19 aa, Artificial Sequence
  CD3-HCDR2
RIRSKYNNYATYYADSVKG

SEQ ID NO: 441 - protein, 14 aa, Artificial Sequence
  CD3-HCDR3
HGNFGNSYVSWFAY

SEQ ID NO: 442 - protein, 14 aa, Artificial Sequence
  CD3-LCDR1
GSSTGAVTTSNYAN

SEQ ID NO: 443 - protein, 7 aa, Artificial Sequence
  CD3-LCDR2
GTNKRAP

SEQ ID NO: 444 - protein, 9 aa, Artificial Sequence
  CD3-LCDR3
ALWYSNLWV

SEQ ID NO: 445 - protein, 125 aa, Artificial Sequence
  CD3 VH
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSS

SEQ ID NO: 446 - protein, 109 aa, Artificial Sequence
  CD3 VL
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVL

SEQ ID NO: 447 - protein, 5 aa, Artificial Sequence
  CD20-HCDR1
YSWIN

SEQ ID NO: 448 - protein, 16 aa, Artificial Sequence
  CD20-HCDR2
RIFPGDGDTDYNGKFK

SEQ ID NO: 449 - protein, 10 aa, Artificial Sequence
  CD20-HCDR3
NVFDGYWLVY

SEQ ID NO: 450 - protein, 16 aa, Artificial Sequence
  CD20-LCDR1
RSSKSLLHSNGITYLY

SEQ ID NO: 451 - protein, 7 aa, Artificial Sequence
  CD20-LCDR2
QMSNLVS

SEQ ID NO: 452 - protein, 9 aa, Artificial Sequence
  CD20-LCDR3
AQNLELPYT

SEQ ID NO: 453 - protein, 119 aa, Artificial Sequence
  CD20 VH
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 454 - protein, 115 aa, Artificial Sequence
  CD20 VL
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTV

SEQ ID NO: 455 - protein, 672 aa, Artificial Sequence
  CD20 VH-CH1(EE)-CD3 VL-CH1-Fc (knob, P329G LALA)CD20 VH-CH1(EE)-CD3 VL-CH1-Fc (knob, P329G LALA)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 456 - protein, 447 aa, Artificial Sequence
  CD20 VH-CH1(EE)-Fc (hole, P329G LALA)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 457 - protein, 219 aa, Artificial Sequence
  CD20 VL-CL(RK)
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 232 aa, Artificial Sequence; identical to SEQ ID NO: 165
  CD3 VH-CL

SEQ ID NO: 459 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 460 - protein, 118 aa, Artificial Sequence [sequence omitted]

SEQ ID NO: 461 - protein, 107 aa, Artificial Sequence [sequence omitted]

SEQ ID NO: 462 - protein, 121 aa, Artificial Sequence
  VH (PD-L1) 2
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 463 - protein, 108 aa, Artificial Sequence
  VL (PD-L1) 2
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 464 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 465 - protein, 120 aa, Artificial Sequence [sequence omitted]

SEQ ID NO: 466 - protein, 111 aa, Artificial Sequence [sequence omitted]

SEQ ID NO: 467 - protein, 113 aa, Artificial Sequence [sequence omitted]

SEQ ID NO: 468 - protein, 107 aa, Artificial Sequence [sequence omitted]

SEQ ID NO: 469 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 470 - protein, 315 aa, Mus musculus
MAGPQALAFGLLLAVVTATLAAAQRDCVCDNYKLATSCSLNEYGECQCTSYGTQNTVICSKLASKCLAMKAEMTHSKSGRRIKPEGAIQNNDGLYDPDCDEQGLFKAKQCNGTATCWCVNTAGVRRTDKDTEITCSERVRTYWIIIELKHKERESPYDHQSLQTALQEAFTSRYKLNQKFIKNIMYENNVITIDLMQNSSQKTQDDVDIADVAYYFEKDVKGESLFHSSKSMDLRVNGEPLDLDPGQTLIYYVDEKAPEFSMQGLTAGIIAVIVVVSLAVIAGIVVLVISTRKKSAKYEKAEIKEMGEIHRELNA

SEQ ID NO: 471 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 472 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 473 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 474 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 475 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 476 - protein, 345 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 477 - protein, 98 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 478 - protein, 107 aa, Homo sapiens
APELLGGPSVFLFPPKPKDTLMISRTPEVTCVWDVSHEDPEVKFNWYVDGVEVHNAKTKPREEQESTYRWSVLTVLHQDWLNGKEYKCKVSNKALPAPIEKTISKAK

SEQ ID NO: 479 - protein, 106 aa, Homo sapiens [sequence omitted]

SEQ ID NO: 480 - protein, 5 aa, Homo sapiens
EPKSC

SEQ ID NO: 481 - protein, 10 aa, Homo sapiens
  MISC_FEATURE (8)..(8): X is S or P
DKTHTCPXCP

SEQ ID NO: 482 - protein, 7 aa, Homo sapiens
  MISC_FEATURE (5)..(5): X is S or P
HTCPXCP

SEQ ID NO: 483 - protein, 5 aa, Homo sapiens
  MISC_FEATURE (3)..(3): X is S or P
CPXCP

SEQ ID NO: 484 - protein, 330 aa, Homo sapiens [sequence omitted]

SEQ ID NO: 485 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 487 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 488 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 489 - protein, 5 aa, Artificial Sequence
  CD28(variant 8) CDR-H1
SYYIH

SEQ ID NO: 490 - protein, 17 aa, Artificial Sequence
  CD28(variant 8) CDR-H2
SIYPGNVQTNYNEKFKD

SEQ ID NO: 491 - protein, 11 aa, Artificial Sequence
  CD28(variant 8) CDR-H3
SHYGLDWNFDV

SEQ ID NO: 492 - protein, 11 aa, Artificial Sequence
  CD28(variant 8) CDR-L1
HASQNIYVYLN

SEQ ID NO: 493 - protein, 7 aa, Artificial Sequence
  CD28(variant 8) CDR-L2
KASNLHT

SEQ ID NO: 494 - protein, 9 aa, Artificial Sequence
  CD28(variant 8) CDR-L3
QQGQTYPYT

SEQ ID NO: 495 - protein, 5 aa, Artificial Sequence
  CD28(variant 15) CDR-H1
SYYIH

SEQ ID NO: 496 - protein, 17 aa, Artificial Sequence
  CD28(variant 15) CDR-H2
SIYPGNVQTNYNEKFKD

SEQ ID NO: 497 - protein, 11 aa, Artificial Sequence
  CD28(variant 15) CDR-H3
SHYGLDWNFDV

SEQ ID NO: 498 - protein, 11 aa, Artificial Sequence
  CD28(variant 15) CDR-L1
HASQNIYVFLN

SEQ ID NO: 499 - protein, 7 aa, Artificial Sequence
  CD28(variant 15) CDR-L2
KASNLHT

SEQ ID NO: 500 - protein, 9 aa, Artificial Sequence
  CD28(variant 15) CDR-L3
QQGQTYPYT

SEQ ID NO: 501 - protein, 5 aa, Artificial Sequence
  CD28(variant 29) CDR-H1
SYYIH

SEQ ID NO: 502 - protein, 17 aa, Artificial Sequence
  CD28(variant 29) CDR-H2
SIYPGNVNTNYNEKFKD

SEQ ID NO: 503 - protein, 11 aa, Artificial Sequence
  CD28(variant 29) CDR-H3
SHYGLDWNFDV

SEQ ID NO: 504 - protein, 11 aa, Artificial Sequence
  CD28(variant 29) CDR-L1
HASQNIYVWLN

SEQ ID NO: 505 - protein, 7 aa, Artificial Sequence
  CD28(variant 29) CDR-L2
KASNLHT

SEQ ID NO: 506 - protein, 9 aa, Artificial Sequence
  CD28(variant 29) CDR-L3
QQGQTYPYT

SEQ ID NO: 507 - protein, 5 aa, Artificial Sequence
  CEA (T84.66-LCHA)- CDR-H1
DTYMH

SEQ ID NO: 508 - protein, 17 aa, Artificial Sequence
  CEA (T84.66-LCHA)- CDR-H2
RIDPANGNSKYVPKFQG

SEQ ID NO: 509 - protein, 12 aa, Artificial Sequence
  CEA (T84.66-LCHA)- CDR-H3
FGYYVSDYAMAY

SEQ ID NO: 510 - protein, 15 aa, Artificial Sequence
  CEA (T84.66-LCHA)- CDR-L1
RAGESVDIFGVGFLH

SEQ ID NO: 511 - protein, 7 aa, Artificial Sequence
  CEA (T84.66-LCHA)- CDR-L2
RASNRAT

SEQ ID NO: 512 - protein, 9 aa, Artificial Sequence
  CEA (T84.66-LCHA)- CDR-L3
QQTNEDPYT

SEQ ID NO: 513 - protein, 121 aa, Artificial Sequence
  CEA (T84.66-LCHA) VH
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 514 - protein, 111 aa, Artificial Sequence
  CEA (T84.66-LCHA) VL
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 515 - protein, 5 aa, Artificial Sequence
  EpCAM (MT201)- CDR-H1
SYGMH

SEQ ID NO: 516 - protein, 17 aa, Artificial Sequence
  EpCAM (MT201)- CDR-H2
VISYDGSNKYYADSVKG

SEQ ID NO: 517 - protein, 16 aa, Artificial Sequence
  EpCAM (MT201)- CDR-H3
DMGWGSGWRPYYYYGM

SEQ ID NO: 518 - protein, 11 aa, Artificial Sequence
  EpCAM (MT201)- CDR-L1
RTSQSISSYLN

SEQ ID NO: 519 - protein, 7 aa, Artificial Sequence
  EpCAM (MT201)- CDR-L2
WASTRES

SEQ ID NO: 520 - protein, 9 aa, Artificial Sequence
  EpCAM (MT201)- CDR-L3
QQSYDIPYT

SEQ ID NO: 521 - protein, 127 aa, Artificial Sequence
  EpCAM (MT201) VH
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 522 - protein, 107 aa, Artificial Sequence
  EpCAM (MT201) VL
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK

SEQ ID NO: 523 - protein, 5 aa, Artificial Sequence
  HER3- CDR-H1
SSYIS

SEQ ID NO: 524 - protein, 17 aa, Artificial Sequence
  HER3- CDR-H2
WIYAGTGSPSYNQKLQG

SEQ ID NO: 525 - protein, 9 aa, Artificial Sequence
  HER3- CDR-H3
HRDYYSNSL

SEQ ID NO: 526 - protein, 17 aa, Artificial Sequence
  HER3- CDR-L1
KSSQSVLNSGNQKNYLT

SEQ ID NO: 527 - protein, 7 aa, Artificial Sequence
  HER3- CDR-L2
WASTRES

SEQ ID NO: 528 - protein, 9 aa, Artificial Sequence
  HER3- CDR-L3
QSDYSYPYT

SEQ ID NO: 529 - protein, 120 aa, Artificial Sequence
  HER3 VH
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSS

SEQ ID NO: 530 - protein, 113 aa, Artificial Sequence
  HER3 VL
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIK

SEQ ID NO: 531 - protein, 5 aa, Artificial Sequence
  CD30- CDR-H1
DYYIT

SEQ ID NO: 532 - protein, 17 aa, Artificial Sequence
  CD30- CDR-H2
WIYPGSGNTKYNEKFKG

SEQ ID NO: 533 - protein, 6 aa, Artificial Sequence
  CD30- CDR-H3
YGNYWF

SEQ ID NO: 534 - protein, 15 aa, Artificial Sequence
  CD30- CDR-L1
KASQSVDFDGDSYMN

SEQ ID NO: 535 - protein, 7 aa, Artificial Sequence
  CD30- CDR-L2
AASTLQI

SEQ ID NO: 536 - protein, 9 aa, Artificial Sequence
  CD30- CDR-L3
QQSNEDPWT

SEQ ID NO: 537 - protein, 117 aa, Artificial Sequence
  CD30 VH
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 538 - protein, 111 aa, Artificial Sequence
  CD30 VL
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIK

SEQ ID NO: 539 - protein, 5 aa, Artificial Sequence
  TPBG(FAB091)- CDR-H1
SDAMH

SEQ ID NO: 540 - protein, 17 aa, Artificial Sequence
  TPBG(FAB091)- CDR-H2
GVSGSGGSPYYADSVKG

SEQ ID NO: 541 - protein, 15 aa, Artificial Sequence
  TPBG(FAB091)- CDR-H3
GGSIAGSYYYYPMDV

SEQ ID NO: 542 - protein, 11 aa, Artificial Sequence
  TPBG(FAB091)- CDR-L1
QASQDISNYLN

SEQ ID NO: 543 - protein, 7 aa, Artificial Sequence
  TPBG(FAB091)- CDR-L2
AASTLQI

SEQ ID NO: 544 - protein, 9 aa, Artificial Sequence
  TPBG(FAB091)- CDR-L3
QQANSFPLT

SEQ ID NO: 545 - protein, 124 aa, Artificial Sequence
  TPBG(FAB091) VH
EVHLLESGGGLVHPGGSLRLSCAASGFTFRSDAMHWVRQAPGKGLEWVSGVSGSGGSPYYADSVKGRFTISRDDSKTTLYLQMNSLRAEDTAVYYCATGGSIAGSYYYYPMDVWGQGTTVTVSS

SEQ ID NO: 546 - protein, 107 aa, Artificial Sequence
  TPBG(FAB091) VL
DIQMTQSPSSLSASVGDRVTITCQASQDISNYLNWYQQKPGKAPKLLIYAASTLQIGVPSRFSGSGSGTDFTFTISSLQPEDFATYYCQQANSFPLTFGGGTKVEIK

SEQ ID NO: 547 - protein, 5 aa, Artificial Sequence
  CD38- CDR-H1
SFAMS

SEQ ID NO: 548 - protein, 17 aa, Artificial Sequence
  CD38- CDR-H2
AISGSGGGTYYADSVKG

SEQ ID NO: 549 - protein, 13 aa, Artificial Sequence
  CD38- CDR-H3
DKILWFGEPVFDY

SEQ ID NO: 550 - protein, 11 aa, Artificial Sequence
  CD38- CDR-L1
RASQSVSSYLA

SEQ ID NO: 551 - protein, 7 aa, Artificial Sequence
  CD38- CDR-L2
DASNRAT

SEQ ID NO: 552 - protein, 9 aa, Artificial Sequence
  CD38- CDR-L3
QQRSNWPPT

SEQ ID NO: 553 - protein, 122 aa, Artificial Sequence [sequence omitted]

SEQ ID NO: 554 - protein, 107 aa, Artificial Sequence [sequence omitted]

SEQ ID NO: 555 - protein, 5 aa, Artificial Sequence
  BCMA - CDR-H1
SYAMN

SEQ ID NO: 556 - protein, 17 aa, Artificial Sequence
  BCMA - CDR-H2
AITASGGSTYYADSVKG

SEQ ID NO: 557 - protein, 6 aa, Artificial Sequence
  BCMA - CDR-H3
YWPMSL

SEQ ID NO: 558 - protein, 12 aa, Artificial Sequence
  BCMA - CDR-L1
RASQSVSAYYLA

SEQ ID NO: 559 - protein, 7 aa, Artificial Sequence
  BCMA - CDR-L2
DASIRAT

SEQ ID NO: 560 - protein, 9 aa, Artificial Sequence
  BCMA - CDR-L3
QQYERWPLT

SEQ ID NO: 561 - protein, 115 aa, Artificial Sequence
  BCMA VH
EVQLLESGGGLVQPGGSLRLSCAASGFTFSSYAMNWVRQAPGKGLEWVSAITASGGSTYYADSVKGRFTISRDNSKNTLYLQMNSLRAEDTAVYYCARYWPMSLWGQGTLVTVSS

SEQ ID NO: 562 - protein, 108 aa, Artificial Sequence
  BCMA VL
EIVLTQSPGTLSLSPGERATLSCRASQSVSAYYLAWYQQKPGQAPRLLMYDASIRATGIPDRFSGSGSGTDFTLTISRLEPEDFAVYYCQQYERWPLTFGQGTKVEIK

SEQ ID NO: 563 - protein, 5 aa, Artificial Sequence
  GPRC5D (5E11) - CDR-H1
KYAMA

SEQ ID NO: 564 - protein, 17 aa, Artificial Sequence
  GPRC5D (5E11) - CDR-H2
SISTGGVNTYYADSVKG

SEQ ID NO: 565 - protein, 8 aa, Artificial Sequence
  GPRC5D (5E11) - CDR-H3
HTGDYFDY

SEQ ID NO: 566 - protein, 15 aa, Artificial Sequence
  GPRC5D (5E11) - CDR-L1
RASQSVSISGINLMN

SEQ ID NO: 567 - protein, 7 aa, Artificial Sequence
  GPRC5D (5E11) - CDR-L2
HASILAS

SEQ ID NO: 568 - protein, 9 aa, Artificial Sequence
  GPRC5D (5E11) - CDR-L3
QQTRESPLT

SEQ ID NO: 569 - protein, 117 aa, Artificial Sequence
  GPRC5D (5E11) VH1c
EVQLLESGGGLVQPGGSLRLSCAASGFTFSKYAMAWVRQAPGKGLEWVASISTGGVNTYYADSVKGRFTISRDNSKNTLYLQMNSLRAEDTAVYYCATHTGDYFDYWGQGTMVTVSS

SEQ ID NO: 570 - protein, 111 aa, Artificial Sequence
  GPRC5D (5E11) VL2b
EIVLTQSPGTLSLSPGERATLSCRASQSVSISGINLMNWYQQKPGQQPKLLIYHASILASGIPDRFSGSGSGTDFTLTISRLEPEDFAVYYCQQTRESPLTFGQGTRLEIK

SEQ ID NO: 571 - protein, 117 aa, Artificial Sequence
  GPRC5D (5E11) VH1a
EVQLLESGGGLVQPGGSLRLSCAASGFTFSKYAMAWVRQAPGKGLEWVASISTGGVNTYYRDSVKARFTISRDNSKNTLYLQMNSLRAEDTAVYYCATHTGDYFDYWGQGTMVTVSS

SEQ ID NO: 572 - protein, 117 aa, Artificial Sequence
  GPRC5D (5E11) VH1b
ELQLLESGGGLVQPGGSLRLSCAASGFTFSKYAMAWVRQAPGKGLEWVASISTGGVNTYYRDSVKARFTISRDNAKNTLYLQMNSLRAEDTAVYYCATHTGDYFDYWGQGTMVTVSS

SEQ ID NO: 573 - protein, 117 aa, Artificial Sequence
  GPRC5D (5E11) VH1d
ELQLLESGGGLVQPGGSLRLSCAASGFTFSKYAMAWVRQAPGKGLEWVASISTGGVNTYYADSVKGRFTISRDNAKNTLYLQMNSLRAEDTAVYYCATHTGDYFDYWGQGTMVTVSS

SEQ ID NO: 574 - protein, 111 aa, Artificial Sequence
  GPRC5D (5E11) VL1a
DIVMTQSPDSLAVSLGERATINCRASQSVSISGINLMNWYQQKPGQQPKLLIYHASILASGVPDRFSGSGSGTDFTLTISSLQAEDVAVYYCQQTRESPLTFGQGTRLEIK

SEQ ID NO: 575 - protein, 111 aa, Artificial Sequence
  GPRC5D (5E11) VL1c
DIVMTQSPDSLAVSLGERATINCKSSQSVSISGINLMNWYQQKPGQQPKLLIYHASILASGVPDRFSGSGSGTDFTLTISSLQAEDVAVYYCQQTRESPLTFGQGTRLEIK

SEQ ID NO: 576 - protein, 111 aa, Artificial Sequence
  GPRC5D (5E11) VL2a
EIVLTQSPGTLSLSPGERATLSCRASQSVSISGINLMNWYQQKPGQQPRLLIYHASILASGIPDRFSGSGSGTDFTLTISRLEPEDFAVYYCQQTRESPLTFGQGTRLEIK

SEQ ID NO: 577 - protein, 111 aa, Artificial Sequence
  GPRC5D (5E11) VL3a
DIQMTQSPSSLSASVGDRVTITCRASQSVSISGINLMNWYQQKPGKQPKLLIYHASILASGVPSRFSGSGSGTDFTLTISSLQPEDFATYYCQQTRESPLTFGQGTRLEIK

SEQ ID NO: 578 - protein, 111 aa, Artificial Sequence
  GPRC5D (5E11) VL3b
DIQMTQSPSSLSASVGDRVTITCRASQSVSISGINLMNWYQQKPGQQPKLLIYHASILASGVPSRFSGSGSGTDFTLTISSLQPEDFATYYCQQTRESPLTFGQGTRLEIK

SEQ ID NO: 579 - protein, 5 aa, Artificial Sequence
  GPRC5D (5F11) - CDR-H1
NYGMA

SEQ ID NO: 580 - protein, 17 aa, Artificial Sequence
  GPRC5D (5F11) - CDR-H2
SISTGGGNTYYRDSVKG

SEQ ID NO: 581 - protein, 7 aa, Artificial Sequence
  GPRC5D (5F11) - CDR-H3
HDRGGLY

SEQ ID NO: 582 - protein, 16 aa, Artificial Sequence
  GPRC5D (5F11) - CDR-L1
RSSKSLLHSNGITYVY

SEQ ID NO: 583 - protein, 7 aa, Artificial Sequence
  GPRC5D (5F11) - CDR-L2
RMSNRAS

SEQ ID NO: 584 - protein, 9 aa, Artificial Sequence
  GPRC5D (5F11) - CDR-L3
GQLLENPYT

SEQ ID NO: 585 - protein, 116 aa, Artificial Sequence
  GPRC5D (5F11) VH1a
QVQLVESGGGVVQPGRSLRLSCAASGFSFSNYGMAWVRQAPGKGLEWVASISTGGGNTYYRDSVKGRFTISRDNSKNTLYLQMNSLRAEDTAVYYCTRHDRGGLYWGQGTMVTVSS

SEQ ID NO: 586 - protein, 116 aa, Artificial Sequence
  GPRC5D (5F11) VH1b
EVQLVESGGGVVQPGRSLRLSCAASGFSFSNYGMAWVRQAPGKGLEWVASISTGGGNTYYRDSVKGRFTISRDNAKNTLYLQMNSLRAEDTAVYYCTRHDRGGLYWGQGTMVTVSS

SEQ ID NO: 587 - protein, 116 aa, Artificial Sequence
  GPRC5D (5F11) VH1c
QVQLVESGGGVVQPGRSLRLSCAASGFSFSNYGMAWVRQAPGKGLEWVASISTGGGNTYYADSVKGRFTISRDNSKNTLYLQMNSLRAEDTAVYYCTRHDRGGLYWGQGTMVTVSS

SEQ ID NO: 588 - protein, 116 aa, Artificial Sequence
  GPRC5D (5F11) VH1d
EVQLVESGGGVVQPGRSLRLSCAASGFSFSNYGMAWVRQAPGKGLEWVASISTGGGNTYYADSVKGRFTISRDNAKNTLYLQMNSLRAEDTAVYYCTRHDRGGLYWGQGTMVTVSS

SEQ ID NO: 589 - protein, 116 aa, Artificial Sequence
  GPRC5D (5F11) VH2b
EVQLVESGGGLVQPGGSLRLSCAASGFSFSNYGMAWVRQAPGKGLEWVASISTGGGNTYYRDSVKGRFTISRDNAKNTLYLQMNSLRAEDTAVYYCTRHDRGGLYWGQGTMVTVSS

SEQ ID NO: 590 - protein, 116 aa, Artificial Sequence
  GPRC5D (5F11) VH2d
EVQLVESGGGLVQPGGSLRLSCAASGFSFSNYGMAWVRQAPGKGLEWVASISTGGGNTYYADSVKGRFTISRDNAKNTLYLQMNSLRAEDTAVYYCTRHDRGGLYWGQGTMVTVSS

SEQ ID NO: 591 - protein, 112 aa, Artificial Sequence
  GPRC5D (5F11) VL1a
DIVMTQSPLSLPVTPGEPASISCRSSKSLLHSNGITYVYWYLQKPGQSPQVLIYRMSNLASGVPDRFSGSGSGTDFTLKISRVEAEDVGVYHCGQLLENPYTFGQGTKLEIK

SEQ ID NO: 592 - protein, 112 aa, Artificial Sequence
  GPRC5D (5F11) VL1b
DIVMTQSPLSLPVTPGEPASISCRSSKSLLHSNGITYVYWYLQKPGKSPQVLIYRMSNLASGVPDRFSGSGSGTDFTLKISRVEAEDVGVYHCGQLLENPYTFGQGTKLEIK

SEQ ID NO: 593 - protein, 112 aa, Artificial Sequence
  GPRC5D (5F11) VL2a
DIVMTQSPLSLPVTPGEPASISCRSSKSLLHSNGITYVYWYLQKPGQSPQLLIYRMSNRASGVPDRFSGSGSGTDFTLKISRVEAEDVGVYHCGQLLENPYTFGQGTKLEIK

SEQ ID NO: 594 - protein, 112 aa, Artificial Sequence
  GPRC5D (5F11) VL2b
DIVMTQSPDSLAVSLGERATINCKSSKSLLHSNGITYVYWYQQKPGQPPKLLIYRMSNLASGVPDRFSGSGSGTDFTLTISSLQAEDVAVYHCGQLLENPYTFGQGTKLEIK

SEQ ID NO: 595 - protein, 112 aa, Artificial Sequence
  GPRC5D (5F11) VL2c
EIVLTQSPGTLSLSPGERATLSCRASKSLLHSNGITYVYWYQQKPGQAPRLLIYRMSNLASGIPDRFSGSGSGTDFTLTISRLEPEDFAVYHCGQLLENPYTFGQGTKLEIK

SEQ ID NO: 596 - protein, 5 aa, Artificial Sequence
  CD3 (Cl22) CDR-H1
SYAMN

SEQ ID NO: 597 - protein, 19 aa, Artificial Sequence
  CD3 (Cl22) CDR-H2
RIRSKYNNYATYYADSVKG

SEQ ID NO: 598 - protein, 14 aa, Artificial Sequence
  CD3 (Cl22) CDR-H3
HTTFPSSYVSYYGY

SEQ ID NO: 599 - protein, 14 aa, Artificial Sequence
  CD3 (Cl22) CDR-L1
GSSTGAVTTSNYAN

SEQ ID NO: 600 - protein, 7 aa, Artificial Sequence
  CD3 (Cl22) CDR-L2
GTNKRAP

SEQ ID NO: 601 - protein, 9 aa, Artificial Sequence
  CD3 (Cl22) CDR-L3
ALWYSNLWV

SEQ ID NO: 602 - protein, 125 aa, Artificial Sequence
  CD3 (Cl22) VH
EVQLLESGGGLVQPGGSLRLSCAASGFQFSSYAMNWVRQAPGKGLEWVSRIRSKYNNYATYYADSVKGRFTISRDDSKNTLYLQMNSLRAEDTAVYYCVRHTTFPSSYVSYYGYWGQGTLVTVSS

SEQ ID NO: 603 - protein, 109 aa, Artificial Sequence; identical to SEQ ID NO: 446
  CD3 (Cl22) VL

SEQ ID NO: 604 - protein, 10 aa, Artificial Sequence
  CD3 (V9) CDR-H1
GYSFTGYTMN

SEQ ID NO: 605 - protein, 17 aa, Artificial Sequence
  CD3 (V9) CDR-H2
LINPYKGVSTYNQKFKD

SEQ ID NO: 606 - protein, 13 aa, Artificial Sequence
  CD3 (V9) CDR-H3
SGYYGDSDWYFDV

SEQ ID NO: 607 - protein, 11 aa, Artificial Sequence
  CD3 (V9) CDR-L1
RASQDIRNYLN

SEQ ID NO: 608 - protein, 7 aa, Artificial Sequence
  CD3 (V9) CDR-L2
YTSRLES

SEQ ID NO: 609 - protein, 9 aa, Artificial Sequence
  CD3 (V9) CDR-L3
QQGNTLPWT

SEQ ID NO: 610 - protein, 122 aa, Artificial Sequence [sequence omitted]

SEQ ID NO: 611 - protein, 107 aa, Artificial Sequence [sequence omitted]

SEQ ID NO: 612 - protein, 120 aa, Artificial Sequence [sequence omitted]

SEQ ID NO: 613 - protein, 107 aa, Artificial Sequence [sequence omitted]

The invention claimed is:

1. A bispecific agonistic CD28 antigen binding molecule characterized by monovalent binding to CD28, comprising
    (a) one antigen binding domain capable of specific binding to CD28, wherein the antigen binding domain capable of specific binding to CD28 comprises a heavy chain variable region (VHCD28) comprising a CDR-H1 of SEQ ID NO: 489, a CDR-H2 of SEQ ID NO: 490, and a CDR-H3 of SEQ ID NO:38 (SHYGX5DX6NFDV) wherein X5 is L and X6 is F, and a light chain variable region (VLCD28) comprising a CDR-L1 of SEQ ID NO: 492, a CDR-L2 of SEQ ID NO: 493 and a CDR-L3 of SEQ ID NO: 494;
    (b) at least one antigen binding domain capable of specific binding to a tumor-associated antigen, and
    (c) a Fc domain composed of a first and a second subunit capable of stable association comprising one or more amino acid substitution that reduces the binding affinity of the antigen binding molecule to an Fc receptor and/or effector function compared to a native IgG1 Fc domain.

2. The bispecific agonistic CD28 antigen binding molecule of claim 1, wherein the Fc domain is of human IgG1 subclass and comprises the amino acid mutations L234A, L235A and P329G, numbering according to Kabat EU index.

3. The bispecific agonistic CD28 antigen binding molecule of claim 1, wherein the antigen binding domain capable of specific binding to CD28 comprises a heavy chain variable region ($V_H$CD28) comprising the amino acid sequence of SEQ ID NO:47 and a light chain variable region ($V_L$CD28) comprising the amino acid sequence of SEQ ID NO:54.

4. The bispecific agonistic CD28 antigen binding molecule of claim 1, wherein the tumor-associated antigen is selected from the group consisting of Fibroblast Activation Protein (FAP), Carcinoembryonic Antigen (CEA), Folate receptor alpha (FolR1), Melanoma-associated Chondroitin Sulfate Proteoglycan (MCSP), Epidermal Growth Factor Receptor (EGFR), human epidermal growth factor receptor 2 (HER2), p95HER2, epithelial cell adhesion molecule (EpCAM), HER3, CD30, TPBG (5T4), CD19, CD79b, CD20, CD22, CD37, CD38, BCMA and GPRC5D.

5. The bispecific agonistic CD28 antigen binding molecule of claim 1, wherein the antigen binding domain capable of specific binding to a tumor-associated antigen is an antigen binding domain capable of specific binding to Carcinoembryonic Antigen (CEA).

6. The bispecific agonistic CD28 antigen binding molecule of claim 5, wherein the antigen binding domain capable of specific binding to CEA comprises
   (i) a heavy chain variable region ($V_H$CEA) comprising a CDR-H1 comprising the amino acid sequence of SEQ ID NO:180, a CDR-H2 comprising the amino acid sequence of SEQ ID NO:181, and a CDR-H3 comprising the amino acid sequence of SEQ ID NO:182, and a light chain variable region ($V_L$CEA) comprising a CDR-L1 comprising the amino acid sequence of SEQ ID NO:183, a CDR-L2 comprising the amino acid sequence of SEQ ID NO:184, and a CDR-L3 comprising the amino acid sequence of SEQ ID NO:185; or
   (ii) a heavy chain variable region ($V_H$CEA) comprising a CDR-H1 comprising the amino acid sequence of SEQ ID NO:127, a CDR-H2 comprising the amino acid sequence of SEQ ID NO:128, and a CDR-H3 comprising the amino acid sequence of SEQ ID NO:129, and a light chain variable region ($V_L$CEA) comprising a CDR-L1 comprising the amino acid sequence of SEQ ID NO:130, a CDR-L2 comprising the amino acid sequence of SEQ ID NO:131, and a CDR-L3 comprising the amino acid sequence of SEQ ID NO:132,
   (iii) a heavy chain variable region ($V_H$CEA) comprising a CDR-H1 comprising the amino acid sequence of SEQ ID NO:507, a CDR-H2 comprising the amino acid sequence of SEQ ID NO:508, and a CDR-H3 comprising the amino acid sequence of SEQ ID NO:509, and a light chain variable region ($V_L$CEA) comprising a CDR-L1 comprising the amino acid sequence of SEQ ID NO:510, a CDR-L2 comprising the amino acid sequence of SEQ ID NO:511, and a CDR-L3 comprising the amino acid sequence of SEQ ID NO:512.

7. The bispecific agonistic CD28 antigen binding molecule of claim 5, wherein the antigen binding domain capable of specific binding to CEA comprises a heavy chain variable region ($V_H$CEA) comprising the amino acid sequence of SEQ ID NO:186, and a light chain variable region ($V_L$CEA) comprising the amino acid sequence of SEQ ID NO:187.

8. The bispecific agonistic CD28 antigen binding molecule of claim 5, wherein the antigen binding domain capable of specific binding to CEA comprises
   (a) a heavy chain variable region ($V_H$CEA) comprising the amino acid sequence of SEQ ID NO:194 and a light chain variable region ($V_L$CEA) comprising the amino acid sequence of SEQ ID NO:195, or
   (b) a heavy chain variable region ($V_H$CEA) comprising the amino acid sequence of SEQ ID NO:196 and a light chain variable region ($V_L$CEA) comprising the amino acid sequence of SEQ ID NO:197, or
   (c) a heavy chain variable region ($V_H$CEA) comprising the amino acid sequence of SEQ ID NO:198 and a light chain variable region ($V_L$CEA) comprising the amino acid sequence of SEQ ID NO:199, or
   (d) a heavy chain variable region ($V_H$CEA) comprising the amino acid sequence of SEQ ID NO:200 and a light chain variable region ($V_L$CEA) comprising the amino acid sequence of SEQ ID NO:201, or
   (e) a heavy chain variable region ($V_H$CEA) comprising the amino acid sequence of SEQ ID NO:202 and a light chain variable region ($V_L$CEA) comprising the amino acid sequence of SEQ ID NO:203, or
   (f) a heavy chain variable region ($V_H$CEA) comprising the amino acid sequence of SEQ ID NO:204 and a light chain variable region ($V_L$CEA) comprising the amino acid sequence of SEQ ID NO:205, or
   (g) a heavy chain variable region ($V_H$CEA) comprising the amino acid sequence of SEQ ID NO:206 and a light chain variable region ($V_L$CEA) comprising the amino acid sequence of SEQ ID NO:207, or
   (h) a heavy chain variable region ($V_H$CEA) comprising the amino acid sequence of SEQ ID NO:208 and a light chain variable region ($V_L$CEA) comprising the amino acid sequence of SEQ ID NO:209, or
   (i) a heavy chain variable region ($V_H$CEA) comprising the amino acid sequence of SEQ ID NO:210 and a light chain variable region ($V_L$CEA) comprising the amino acid sequence of SEQ ID NO:211, or
   (j) a heavy chain variable region ($V_H$CEA) comprising the amino acid sequence of SEQ ID NO:212 and a light chain variable region ($V_L$CEA) comprising the amino acid sequence of SEQ ID NO:213.

9. The bispecific agonistic CD28 antigen binding molecule of claim 5, wherein the antigen binding domain capable of specific binding to CEA comprises a heavy chain variable region ($V_H$CEA) comprising the amino acid sequence of SEQ ID NO:200 and a light chain variable region ($V_L$CEA) comprising the amino acid sequence of SEQ ID NO:201.

10. The bispecific agonistic CD28 antigen binding molecule of claim 1, wherein the antigen binding domain capable of specific binding to a tumor-associated antigen is an antigen binding domain capable of specific binding to Fibroblast Activation Protein (FAP).

11. The bispecific agonistic CD28 antigen binding molecule of claim 10, wherein the antigen binding domain capable of specific binding to FAP comprises
   (a) a heavy chain variable region ($V_H$FAP) comprising (i) CDR-H1 comprising the amino acid sequence of SEQ ID NO:12, (ii) CDR-H2 comprising the amino acid sequence of SEQ ID NO:13, and (iii) CDR-H3 comprising the amino acid sequence of SEQ ID NO:14, and a light chain variable region ($V_L$FAP) comprising (iv) CDR-L1 comprising the amino acid sequence of SEQ ID NO:15, (v) CDR-L2 comprising the amino acid sequence of SEQ ID NO:16, and (vi) CDR-L3 comprising the amino acid sequence of SEQ ID NO:17, or
   (b) a heavy chain variable region ($V_H$FAP) comprising (i) CDR-H1 comprising the amino acid sequence of SEQ ID NO:4, (ii) CDR-H2 comprising the amino acid sequence of SEQ ID NO:5, and (iii) CDR-H3 comprising the amino acid sequence of SEQ ID NO:6, and a light chain variable region ($V_L$FAP) comprising (iv) CDR-L1 comprising the amino acid sequence of SEQ ID NO:7, (v) CDR-L2 comprising the amino acid sequence of SEQ ID NO:8, and (vi) CDR-L3 comprising the amino acid sequence of SEQ ID NO:9.

12. The bispecific agonistic CD28 antigen binding molecule of claim 10, wherein the antigen binding domain capable of specific binding to FAP comprises a heavy chain variable region ($V_H$FAP) comprising the amino acid sequence of SEQ ID NO:18 and a light chain variable region ($V_L$FAP) comprising the amino acid sequence of SEQ ID NO:19.

13. The bispecific agonistic CD28 antigen binding molecule of claim 1, wherein the antigen binding domain capable of specific binding to a tumor-associated antigen is an antigen binding domain capable of specific binding to epithelial cell adhesion molecule (EpCAM).

14. The bispecific agonistic CD28 antigen binding molecule of claim 13, wherein the antigen binding domain capable of specific binding to EpCAM comprises a heavy chain variable region ($V_H$EpCAM) comprising (i) CDR-H1 comprising the amino acid sequence of SEQ ID NO:515, (ii) CDR-H2 comprising the amino acid sequence of SEQ ID NO:516, and (iii) CDR-H3 comprising the amino acid sequence of SEQ ID NO:517, and a light chain variable region ($V_L$EpCAM) comprising (iv) CDR-L1 comprising the amino acid sequence of SEQ ID NO:518, (v) CDR-L2 comprising the amino acid sequence of SEQ ID NO:519, and (vi) CDR-L3 comprising the amino acid sequence of SEQ ID NO:520.

15. The bispecific agonistic CD28 antigen binding molecule of claim 13, wherein the antigen binding domain capable of specific binding to EpCAM comprises a heavy chain variable region ($V_H$EpCAM) comprising the amino acid sequence of SEQ ID NO:521 and a light chain variable region ($V_L$EpCAM) comprising the amino acid sequence of SEQ ID NO:522.

16. The bispecific agonistic CD28 antigen binding molecule of claim 1, wherein the antigen binding domain capable of specific binding to a tumor-associated antigen is an antigen binding domain capable of specific binding to HER3.

17. The bispecific agonistic CD28 antigen binding molecule of claim 16, wherein the antigen binding domain capable of specific binding to HER3 comprises a heavy chain variable region ($V_H$HER3) comprising (i) CDR-H1 comprising the amino acid sequence of SEQ ID NO:523, (ii) CDR-H2 comprising the amino acid sequence of SEQ ID NO:524, and (iii) CDR-H3 comprising the amino acid sequence of SEQ ID NO:525, and a light chain variable region ($V_L$HER3) comprising (iv) CDR-L1 comprising the amino acid sequence of SEQ ID NO:526, (v) CDR-L2 comprising the amino acid sequence of SEQ ID NO:527, and (vi) CDR-L3 comprising the amino acid sequence of SEQ ID NO:528.

18. The bispecific agonistic CD28 antigen binding molecule of claim 16, wherein the antigen binding domain capable of specific binding to HER3 comprises a heavy chain variable region ($V_H$HER3) comprising the amino acid sequence of SEQ ID NO:529 and a light chain variable region ($V_L$HER3) comprising the amino acid sequence of SEQ ID NO:530.

19. The bispecific agonistic CD28 antigen binding molecule of claim 1, wherein the antigen binding domain capable of specific binding to a tumor-associated antigen is an antigen binding domain capable of specific binding to CD30.

20. The bispecific agonistic CD28 antigen binding molecule of claim 19, wherein the antigen binding domain capable of specific binding to CD30 comprises a heavy chain variable region ($V_H$CD30) comprising (i) CDR-H1 comprising the amino acid sequence of SEQ ID NO:531, (ii) CDR-H2 comprising the amino acid sequence of SEQ ID NO:532, and (iii) CDR-H3 comprising the amino acid sequence of SEQ ID NO:533, and a light chain variable region ($V_L$CD30) comprising (iv) CDR-L1 comprising the amino acid sequence of SEQ ID NO:534, (v) CDR-L2 comprising the amino acid sequence of SEQ ID NO:535, and (vi) CDR-L3 comprising the amino acid sequence of SEQ ID NO:536.

21. The bispecific agonistic CD28 antigen binding molecule of claim 19, wherein the antigen binding domain capable of specific binding to CD30 comprises a heavy chain variable region ($V_H$CD30) comprising the amino acid sequence of SEQ ID NO:537 and a light chain variable region ($V_L$CD30) comprising the amino acid sequence of SEQ ID NO:538.

22. The bispecific agonistic CD28 antigen binding molecule of claim 1, wherein the antigen binding domain capable of specific binding to a tumor-associated antigen is an antigen binding domain capable of specific binding to TBPG.

23. The bispecific agonistic CD28 antigen binding molecule of claim 22, wherein the antigen binding domain capable of specific binding to TBPG comprises a heavy chain variable region ($V_H$TBPG) comprising (i) CDR-H1 comprising the amino acid sequence of SEQ ID NO:539, (ii) CDR-H2 comprising the amino acid sequence of SEQ ID NO:540, and (iii) CDR-H3 comprising the amino acid sequence of SEQ ID NO:541, and a light chain variable region ($V_L$TBPG) comprising (iv) CDR-L1 comprising the amino acid sequence of SEQ ID NO:542, (v) CDR-L2 comprising the amino acid sequence of SEQ ID NO:543, and (vi) CDR-L3 comprising the amino acid sequence of SEQ ID NO:544.

24. The bispecific agonistic CD28 antigen binding molecule of claim 22, wherein the antigen binding domain capable of specific binding to TBPG comprises a heavy chain variable region ($V_H$TBPG) comprising the amino acid sequence of SEQ ID NO:545 and a light chain variable region ($V_L$TBPG) comprising the amino acid sequence of SEQ ID NO:546.

25. The bispecific agonistic CD28 antigen binding molecule of claim 1, wherein the tumor-associated antigen is a Multiple Myeloma (MM) cell surface antigen selected from the group consisting of CD38, BCMA and GPRC5D.

26. The bispecific agonistic CD28 antigen binding molecule of claim 1, wherein the antigen binding domain capable of specific binding to a tumor-associated antigen is an antigen binding domain capable of specific binding to GPRC5D.

27. The bispecific agonistic CD28 antigen binding molecule of claim 26, wherein the antigen binding domain capable of specific binding to GPRC5D comprises
    (a) a heavy chain variable region ($V_H$GPRC5D) comprising (i) CDR-H1 comprising the amino acid sequence of SEQ ID NO:563, (ii) CDR-H2 comprising the amino acid sequence of SEQ ID NO:564, and (iii) CDR-H3 comprising the amino acid sequence of SEQ ID NO:565, and a light chain variable region ($V_L$GPRC5D) comprising (iv) CDR-L1 comprising the amino acid sequence of SEQ ID NO:566, (v) CDR-L2 comprising the amino acid sequence of SEQ ID NO:567, and (vi) CDR-L3 comprising the amino acid sequence of SEQ ID NO:568, or
    (b) a heavy chain variable region ($V_H$GPRC5D) comprising (i) CDR-H1 comprising the amino acid sequence of SEQ ID NO:579, (ii) CDR-H2 comprising the amino acid sequence of SEQ ID NO:580, and (iii) CDR-H3 comprising the amino acid sequence of SEQ ID NO:581, and a light chain variable region ($V_L$GPRC5D) comprising (iv) CDR-L1 comprising the amino acid sequence of SEQ ID NO:582, (v) CDR-L2 comprising the amino acid sequence of SEQ ID NO:583, and (vi) CDR-L3 comprising the amino acid sequence of SEQ ID NO:584.

28. The bispecific agonistic CD28 antigen binding molecule of claim 26, wherein the antigen binding domain capable of specific binding to GPRC5D comprises a heavy chain variable region ($V_H$GPRC5D) comprising the amino acid sequence of SEQ ID NO:569 and a light chain variable region (V$_L$GPRC5D) comprising the amino acid sequence of SEQ ID NO:570.

29. The bispecific agonistic CD28 antigen binding molecule of claim 1, wherein the antigen binding domain capable of specific binding to a tumor-associated antigen is an antigen binding domain capable of specific binding to CD38.

30. The bispecific agonistic CD28 antigen binding molecule of claim 29, wherein the antigen binding domain capable of specific binding to CD38 comprises a heavy chain variable region (V$_H$CD38) comprising (i) CDR-H1 comprising the amino acid sequence of SEQ ID NO:547, (ii) CDR-H2 comprising the amino acid sequence of SEQ ID NO:548, and (iii) CDR-H3 comprising the amino acid sequence of SEQ ID NO:549, and a light chain variable region (V$_L$CD38) comprising (iv) CDR-L1 comprising the amino acid sequence of SEQ ID NO:550, (v) CDR-L2 comprising the amino acid sequence of SEQ ID NO:551, and (vi) CDR-L3 comprising the amino acid sequence of SEQ ID NO:552.

31. The bispecific agonistic CD28 antigen binding molecule of claim 29, wherein the antigen binding domain capable of specific binding to CD38 comprises a heavy chain variable region (V$_H$CD38) comprising the amino acid sequence of SEQ ID NO:553 and a light chain variable region (V$_L$CD38) comprising the amino acid sequence of SEQ ID NO:554.

32. The bispecific agonistic CD28 antigen binding molecule of claim 1, wherein the antigen binding domain capable of specific binding to a tumor-associated antigen is an antigen binding domain capable of specific binding to BCMA.

33. The bispecific agonistic CD28 antigen binding molecule of claim 32, wherein the antigen binding domain capable of specific binding to BCMA comprises a heavy chain variable region (V$_H$BCMA) comprising (i) CDR-H1 comprising the amino acid sequence of SEQ ID NO:555, (ii) CDR-H2 comprising the amino acid sequence of SEQ ID NO:556, and (iii) CDR-H3 comprising the amino acid sequence of SEQ ID NO:557, and a light chain variable region (V$_L$BCMA) comprising (iv) CDR-L1 comprising the amino acid sequence of SEQ ID NO:558, (v) CDR-L2 comprising the amino acid sequence of SEQ ID NO:559, and (vi) CDR-L3 comprising the amino acid sequence of SEQ ID NO:560.

34. The bispecific agonistic CD28 antigen binding molecule of claim 32, wherein the antigen binding domain capable of specific binding to BCMA comprises a heavy chain variable region (V$_H$BCMA) comprising the amino acid sequence of SEQ ID NO:561 and a light chain variable region (V$_L$BCMA) comprising the amino acid sequence of SEQ ID NO:562.

35. The bispecific agonistic CD28 antigen binding molecule of claim 1, wherein the tumor-associated antigen is a B cell surface antigen selected from the group consisting of CD19, CD79b, CD20, CD22 and CD37.

36. The bispecific agonistic CD28 antigen binding molecule of claim 1, wherein the antigen binding domain capable of specific binding to a tumor-associated antigen is an antigen binding domain capable of specific binding to CD19.

37. The bispecific agonistic CD28 antigen binding molecule of claim 36, wherein the antigen binding domain capable of specific binding to CD19 comprises
(a) a heavy chain variable region (V$_H$CD19) comprising
 (i) CDR-H1 comprising the amino acid sequence of SEQ ID NO:406, (ii) CDR-H2 comprising the amino acid sequence of SEQ ID NO:407, and (iii) CDR-H3 comprising the amino acid sequence of SEQ ID NO:408, and a light chain variable region (V$_L$CD19) comprising (iv) CDR-L1 comprising the amino acid sequence of SEQ ID NO:409, (v) CDR-L2 comprising the amino acid sequence of SEQ ID NO:410, and (vi) CDR-L3 comprising the amino acid sequence of SEQ ID NO:411, or
(b) a heavy chain variable region (V$_H$CD19) comprising (i) CDR-H1 comprising the amino acid sequence of SEQ ID NO:414, (ii) CDR-H2 comprising the amino acid sequence of SEQ ID NO:415, and (iii) CDR-H3 comprising the amino acid sequence of SEQ ID NO:416, and a light chain variable region (V$_L$CD19) comprising (iv) CDR-L1 comprising the amino acid sequence of SEQ ID NO:417, (v) CDR-L2 comprising the amino acid sequence of SEQ ID NO:418, and (vi) CDR-L3 comprising the amino acid sequence of SEQ ID NO:419.

38. The bispecific agonistic CD28 antigen binding molecule of claim 36, wherein the antigen binding domain capable of specific binding to CD19 comprises (a) a heavy chain variable region (V$_H$CD19) comprising the amino acid sequence of SEQ ID NO:412, and a light chain variable region (V$_L$CD19) comprising the amino acid sequence of SEQ ID NO:413, or (b) a heavy chain variable region (V$_H$CD19) comprising the amino acid sequence of SEQ ID NO:420, and a light chain variable region (V$_L$CD19) comprising the amino acid sequence of SEQ ID NO:421.

39. The bispecific agonistic CD28 antigen binding molecule of claim 36, wherein the antigen binding domain capable of specific binding to CD19 comprises a heavy chain variable region (V$_H$CD19) comprising the amino acid sequence of SEQ ID NO:412 and a light chain variable region (V$_L$CD19) comprising the amino acid sequence of SEQ ID NO:413.

40. The bispecific agonistic CD28 antigen binding molecule of claim 1, wherein the antigen binding domain capable of specific binding to a tumor-associated antigen is an antigen binding domain capable of specific binding to CD79b.

41. The bispecific agonistic CD28 antigen binding molecule of claim 40, wherein the antigen binding domain capable of specific binding to CD79b comprises a heavy chain variable region (V$_H$CD79b) comprising (i) CDR-H1 comprising the amino acid sequence of SEQ ID NO:422, (ii) CDR-H2 comprising the amino acid sequence of SEQ ID NO:423, and (iii) CDR-H3 comprising the amino acid sequence of SEQ ID NO:424, and a light chain variable region (V$_L$CD79b) comprising (iv) CDR-L1 comprising the amino acid sequence of SEQ ID NO:425, (v) CDR-L2 comprising the amino acid sequence of SEQ ID NO:426, and (vi) CDR-L3 comprising the amino acid sequence of SEQ ID NO:427.

42. The bispecific agonistic CD28 antigen binding molecule of claim 40, wherein the antigen binding domain capable of binding to CD79b comprises a heavy chain variable region (V$_H$CD79b) comprising the amino acid sequence of SEQ ID NO:428, and a light chain variable region (V$_L$CD79b) comprising the amino acid sequence of SEQ ID NO:429.

43. The bispecific agonistic CD28 antigen binding molecule of claim 1, comprising
(a) one Fab fragment capable of specific binding to CD28,
(b) one crossFab fragment capable of specific binding to a tumor-associated antigen, and (c) a Fc domain composed of a first and a second subunit capable of stable association comprising one or more amino acid substitution that reduces the binding affinity of the antigen binding molecule to an Fc receptor and/or effector function compared to a native IgG1 Fc domain.

44. The bispecific agonistic CD28 antigen binding molecule of claim 1, comprising
(a) a first Fab fragment capable of specific binding to CD28,
(b) a second Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function compared to a native IgG1 Fc domain,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of one of the Fc domain subunits.

45. The bispecific agonistic CD28 antigen binding molecule of claim 1, comprising
(a) a first Fab fragment capable of specific binding to CD28,
(b) a second and a third Fab fragment capable of specific binding to a tumor-associated antigen, and
(c) a Fc domain composed of a first and a second subunit capable of stable association comprising one or more amino acid substitution that reduces the binding affinity of the antigen binding molecule to an Fc receptor and/or effector function compared to a native IgG1 Fc domain,
wherein the first Fab fragment capable of specific binding to CD28 is fused at the C-terminus of the Fab heavy chain to the N-terminus of the Fab heavy chain of the second Fab fragment capable of specific binding to a tumor-associated antigen, which is in turn fused at its C-terminus to the N-terminus of the first Fc domain subunit, and the third Fab fragment capable of specific binding to a tumor-associated antigen is fused at the C-terminus of the Fab heavy chain to the N-terminus of the second Fc domain subunit.

46. A pharmaceutical composition comprising the bispecific agonistic CD28 antigen binding molecule of claim 1 and at least one pharmaceutically acceptable excipient.

47. A bispecific agonistic CD28 antigen binding molecule characterized by monovalent binding to CD28, comprising
(a) one antigen binding domain capable of specific binding to CD28, wherein the antigen binding domain capable of specific binding to CD28 comprises a heavy chain variable region ($V_H$CD28) comprising the amino acid sequence of SEQ ID NO:47 and a light chain variable region ($V_L$CD28) comprising the amino acid sequence of SEQ ID NO:54,
(b) at least one antigen binding domain capable of specific binding to CD19, and
(c) a Fc domain composed of a first and a second subunit capable of stable association, wherein the Fc domain is of human IgG1 subclass and comprises the amino acid mutations L234A, L235A and P329G, numbering according to Kabat EU index.

48. The bispecific agonistic CD28 antigen binding molecule of claim 47, wherein the antigen binding domain capable of specific binding to CD19 comprises a heavy chain variable region ($V_H$CD19) comprising the amino acid sequence of SEQ ID NO:412 and a light chain variable region ($V_L$CD19) comprising the amino acid sequence of SEQ ID NO:413.

49. A bispecific agonistic CD28 antigen binding molecule comprising a first light chain comprising the amino acid sequence of SEQ ID NO:122, a first heavy chain comprising the amino acid sequence of SEQ ID NO:114, a second heavy chain comprising the amino acid sequence of SEQ ID NO:430 and a second light chain comprising the amino acid sequence of SEQ ID NO:431.

* * * * *